US009029525B2

(12) United States Patent
Sah et al.

(10) Patent No.: US 9,029,525 B2
(45) Date of Patent: May 12, 2015

(54) COMPOSITIONS AND METHODS FOR INHIBITING EXPRESSION OF GSK-3 GENES

(75) Inventors: Dinah Wen-Yee Sah, Boston, MA (US); Gregory Hinkle, Plymouth, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 0 days.

(21) Appl. No.: 13/615,164

(22) Filed: Sep. 13, 2012

(65) Prior Publication Data
US 2013/0012572 A1 Jan. 10, 2013

Related U.S. Application Data

(63) Continuation of application No. 13/003,740, filed as application No. PCT/US2009/050432 on Jul. 13, 2009, now abandoned.

(60) Provisional application No. 61/080,153, filed on Jul. 11, 2008.

(51) Int. Cl.
*C07H 21/04* (2006.01)
*C12N 15/11* (2006.01)
*C12N 15/113* (2010.01)

(52) U.S. Cl.
CPC ........ *C12N 15/1137* (2013.01); *C12N 2310/14* (2013.01); *C12N 2310/321* (2013.01); *C12Y 207/11026* (2013.01)

(58) Field of Classification Search
USPC ....................................... 536/24.5; 514/44 A
See application file for complete search history.

(56) References Cited

U.S. PATENT DOCUMENTS

| | | | |
|---|---|---|---|
| 7,427,605 B2 | 9/2008 | Davis et al. | |
| 7,691,997 B2* | 4/2010 | Khvorova et al. | 536/24.5 |
| 7,718,629 B2 | 5/2010 | Bumcrot et al. | |
| 2003/0143732 A1 | 7/2003 | Fosnaugh et al. | |
| 2003/0170891 A1 | 9/2003 | McSwiggen | |
| 2004/0053876 A1* | 3/2004 | Turner et al. | 514/44 |
| 2004/0259247 A1 | 12/2004 | Tuschl et al. | |
| 2006/0263435 A1 | 11/2006 | Davis et al. | |
| 2007/0004664 A1 | 1/2007 | McSwiggen et al. | |
| 2007/0031844 A1 | 2/2007 | Khvorova et al. | |
| 2007/0281899 A1 | 12/2007 | Bumcrot et al. | |
| 2008/0108583 A1 | 5/2008 | Feinstein | |
| 2009/0149403 A1 | 6/2009 | MacLachlan et al. | |
| 2011/0015250 A1 | 1/2011 | Bumcrot et al. | |
| 2012/0244207 A1 | 9/2012 | Fitzgerald et al. | |

FOREIGN PATENT DOCUMENTS

| | | |
|---|---|---|
| WO | WO 00/38675 | 7/2000 |
| WO | WO 03/70918 | 8/2003 |
| WO | WO 2004/080406 | 9/2004 |
| WO | WO 2004/090108 | 10/2004 |
| WO | WO 2006/018633 | 2/2006 |
| WO | WO 2006/063164 | 6/2006 |
| WO | WO 2010/147992 | 12/2010 |

OTHER PUBLICATIONS

Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in Drosophila Melanogaster Embryo Lysate", The EMBO Journal, 2001, pp. 6877-6888, vol. 20, No. 23.
Elbashir, S., et al., "RNA Interference is Mediated by 21-and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in *Caenorhabditis elegans*," Nature, Feb. 19, 1998, pp. 806-811, vol. 391.
Hornung, V., et al., "Sequence-specific potent induction of IFN-α by short interfering RNA in plasmacytoid dendritic cells throughTLR7," Nature Medicine, Mar. 2005, pp. 263-270, vol. 11, No. 3.
Reynolds, et al. (2004) "Rational siRNA design for RNA interference," Nature Biotechnology, vol. 22, No. 3, pp. 326-330.
Robbins, M., et al., "Stable expression of shRNAs in human CD34+ progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA In Vitro," Genes & Development, 1999, pp. 3191-3197, vol. 13.
Tuschl, T., "Expanding small RNA interference," Nature Biotechnology, May 2002, pp. 446-448, vol. 20.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
Weil, et al (2002) "Targeting the Kinesin Eg5 to Monitor siRNA Transfection in Mammalian Cells," *Biotechniques* 33(6):1244-1248.
Zimmerman, et al. (2006) "RNAi-mediated gene silencing in non-human primates," *Nature*, vol. 441, May 4: 111-114.

(Continued)

*Primary Examiner* — Jon E Angell
(74) *Attorney, Agent, or Firm* — Fenwick & West LLP

(57) ABSTRACT

The invention relates to a double-stranded ribonucleic acid (dsRNA) targeting Glycogen Synthase Kinase-3 (GSK-3), and methods of using the dsRNA to inhibit expression of GSK-3.

23 Claims, 7 Drawing Sheets

(56) References Cited

OTHER PUBLICATIONS

Harborth, J., et al: "Sequence, chemical, and structural variation of small interfering RNAs and short hairpin RNAs and the effect on mammalian gene silencing." Antisense & Nucleic Acid Drug Development, Mary Ann Liebert, Inc., New York, US, Apr. 1, 2003, vol. 13, No. 2.

Liao-Xinbo, et al: "Glycogen synthase kinase-3beta activity is required for androgen-stimulated gene expression in prostate cancer." Endocrinology, Jun. 2004, vol. 145, No. 6.

Steuber-Buchberger P., et al: "Simultaneous Cre-mediated conditional knockdown of two genes in mice." Genesis (New York, N. Y.: 2000) Mar. 2008, vol. 46, No. 3.

Yu, J-Y., et al: "Simultaneous inhibition of GSK3[alpha] and GSK3[beta] using hairpin siRNA expression vectors." Molecular Therapy .US, Feb. 1, 2003, vol. 7, No. 2.

International Search Report and Written Opinion, PCT/US2009/050432, Oct. 21, 2010, 21 pages.

\* cited by examiner

US 9,029,525 B2

COMPOSITIONS AND METHODS FOR INHIBITING EXPRESSION OF GSK-3 GENES

CROSS REFERENCE TO RELATED APPLICATIONS

This application is a continuation of U.S. patent application Ser. No. 13/003,740 filed Jun. 13, 20009, which is a 371 national phase of PCT patent application serial number PCT/US2009/050432, filed Jul. 13, 2009, which claims the benefit of U.S. Provisional Application No. 61/080,153, filed Jul. 11, 2008, which are hereby incorporated in their entirety by reference.

STATEMENT REGARDING FEDERALLY SPONSORED RESEARCH OR DEVELOPMENT

None.

FIELD OF THE INVENTION

The invention relates to a double-stranded ribonucleic acid (dsRNA) targeting Glycogen Synthase Kinase-3 alpha and/or beta (GSK-3 alpha and/or beta), and methods of using the dsRNA to inhibit expression of GSK-3. alpha and/or beta.

BACKGROUND OF THE INVENTION

Glycogen synthase kinase-3 (GSK-3) is a multifunctional serine/threonine kinase. It functions as a key regulator of numerous signaling pathways. It phosphorylates and inactivates glycogen synthase, a key enzyme in glycogen metabolism. It has also been shown to be involved in the regulation of a diverse array of cellular functions, including protein synthesis, cell proliferation, cell differentiation, microtubule assembly/disassembly, and apoptosis. Two isoforms of GSK-3 have been reported in mammals: an approximately 51 kDa GSK-3 alpha form and an approximately 47 kDa GSK-3 beta form. These two isoforms exhibit about 98% homology in their kinase domains. Other regions share less homology: they share only about 36% identity in the last 76 C-terminal amino acid residues.

Double-stranded RNA molecules (dsRNA) have been shown to block gene expression in a highly conserved regulatory mechanism known as RNA interference (RNAi). WO 99/32619 (Fire et al.) disclosed the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.).

SUMMARY OF THE INVENTION

The invention provides compositions containing double-stranded ribonucleic acid (dsRNA) targeted to a GSK-3 gene and methods for inhibiting the expression of a GSK-3 gene in a cell or mammal. The composition can inhibit GSK-3 alpha and/or GSK-3 beta. A composition that inhibits both can do so, e.g., by including a dsRNA that targets both GSK-3 alpha and GSK-3 beta, or by including a first dsRNA that inhibits GSK-3 alpha and a second dsRNA that inhibits GSK-3 beta. The composition can also include a dsRNA which inhibits both and a second which inhibits only one of the isoforms.

The invention also provides compositions and methods for treating manic depression (bipolar disorder).

Other disorders, e.g., pathological conditions and diseases caused by the expression of a GSK-3 gene, such as metabolic disorders (e.g., Type I or Type II diabetes or metabolic syndrome) and nervous system disorders, (e.g., CNS and nuerogenerative disorders (e.g., Alzheimer's disease, Parkinson's disease, Huntington's Disease, bipolar disorder, prion diseases (e.g., transmissible spongiform encephalopathies), stroke and schizophrenia). Compositions and methods for treating pathological conditions and diseases such as protozoan diseases (e.g., *Plasmodium falciparum*), cancer (e.g., colorectal cancer), and circadian rhythm diseases (e.g., sleep disorders, jet lag, and shift work), are also provided. The dsRNAs described herein can also be used to regulate skeletal muscle growth, inflammatory responses, platelet function, apoptosis, and cellular responses to DNA damage.

In one embodiment the invention provides a double-stranded ribonucleic acid (dsRNA), having a sense strand and an antisense strand, the sense strand comprising a first sequence and the antisense strand comprising a second sequence, the second sequence comprising a region complementary to an mRNA encoding a GSK-3 gene, and wherein said region of complementarity is less than 30 nucleotides in length. In some embodiments, the second sequence includes a region complementary to the GSK-3 gene sequences NM_019884, NM_00103166, :NM_002093, or NM_019827. In other embodiments, the second sequence includes a region complementary to at least 15 nucleotides of a target sequence described herein, e.g., in Table 1 or Table 2 or Table 4 or Table 5 or Table 6 or Table 7. The second sequence can include a region complementary to a target sequence described in Table 1 or Table 2 or Table 4 or Table 5 or Table 6 or Table 7.

The antisense strand of the dsRNA of the invention can include at least 15 nucleotides of one of the antisense strand sequences in Table 1 or Table 2 or Table 4 or Table 5 or Table 6 or Table 7. In one embodiment, the antisense strand includes one of the antisense strand sequences in Table 1 or Table 2 or Table 4 or Table 5 or Table 6 or Table 7. In another embodiment, the antisense strand consists of one of the antisense strand sequences in Table 1 or Table 2 or Table 4 or Table 5 or Table 6 or Table 7.

The sense strand can include at least 15 nucleotides of one of the sense strand sequences in Table 1 or Table 2 or Table 4 or Table 5 or Table 6 or Table 7. For example, the sense strand can include or can consist of one of the sense strand sequences in Table 1 or Table 2 or Table 4 or Table 5 or Table 6 or Table 7.

In some embodiments, the dsRNA of the invention consists of one of the sense strand sequences in Table 1 or Table 2 or Table 4 or Table 5 or Table 6 or Table 7 and the antisense strand consists of one of the antisense strand sequences in Table 1 or Table 2 or Table 4 or Table 5 or Table 6 or Table 7. Further embodiments include the duplexes disclosed herein, e.g., huGSKA-3, huGSKB-11, AD-18821, AD-18825, AD-18826, AD-18838, AD-18843, or AD-18844.

The dsRNA of the invention can include at least one modified nucleotide. Disclosed herein are exemplary modified sequences, but one of skill can readily design duplexes with different set of modifications using the sequences and teachings herein. The modified nucleotides can be, e.g., a 2'-O-methyl modified nucleotide, a nucleotide comprising a 5'-phosphorothioate group, or a terminal nucleotide linked to a cholesteryl derivative or dodecanoic acid bisdecylamide group. The modified nucleotide(s) can be a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. In one embodiment the dsRNA of the invention includes at least one 2'-O-methyl modified nucleotide and at least one nucleotide comprising a 5'-phosphorothioate group.

The region of complementarity of the dsRNA of the invention is less than 30 nucleotides, e.g., at least 15 nucleotides in length, or, e.g., between 19 and 21 nucleotides in length, or, e.g., 19 nucleotides in length.

Disclosed and claimed herein are methods for inhibiting expression of a GSK-3 gene. In one embodiment, administration of the dsRNA inhibits expression of GSK3 by more than 40%. In another embodiment the dsRNA exhibits an IC50 of less than or equal to 10 nM in suppressing GSK3. Alternatively, the dsRNA exhibits an IC50 of less than or equal to 1.0 nM in suppressing GSK3.

Also included in the invention are cells and vectors comprising the dsRNA of the invention.

Further contemplated is a pharmaceutical composition for inhibiting expression of an GSK-3 gene comprising a dsRNA of the invention.

Methods of inhibiting GSK-3 expression in a cell are included in the invention. The methods include (a) introducing into the cell the dsRNA of the invention; and (b) maintaining the cell produced in step (a) for a time sufficient to obtain degradation of the mRNA transcript of a GSK-3 gene, thereby inhibiting expression of a GSK-3 gene in the cell.

Also included is a method of treating a disorder mediated by GSK-3 expression comprising administering to a human in need of such treatment a therapeutically effective amount of a dsRNA of the invention, including treatment of manic depression.

BRIEF DESCRIPTION OF THE SEVERAL VIEWS OF THE DRAWINGS

These and other features, aspects, and advantages of the present invention will become better understood with regard to the following description, and accompanying drawings, where.

DETAILED DESCRIPTION OF THE INVENTION

Figure 1:
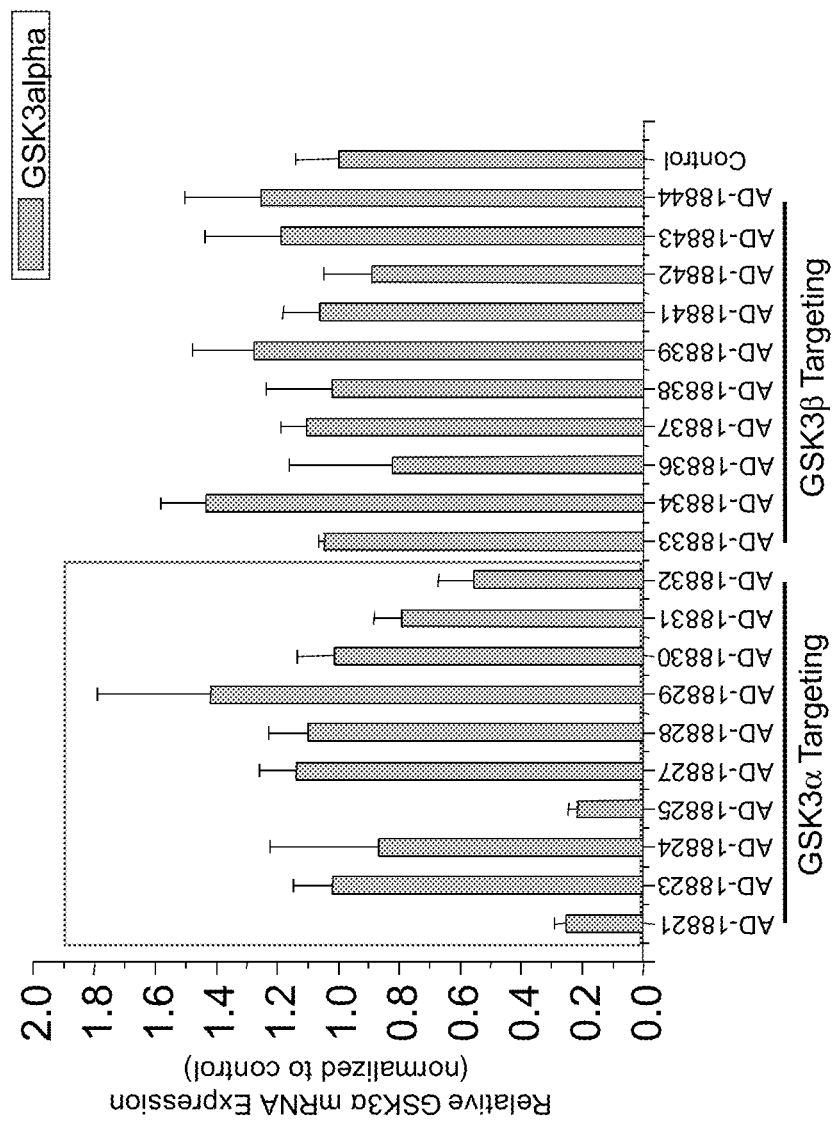
FIG. 1 is a graph illustrating the results of GSK3α mRNA suppression in HT22 cells 24 hours after 37.5 nM siRNA transfection.

The invention provides dsRNAs and methods of using the dsRNAs for inhibiting the expression of a GSK-3 gene in a cell or a mammal where the dsRNA targets a GSK-3 gene. The invention also provides compositions and methods for treating pathological conditions and diseases, such as a metabolic disease or a cardiovascular disease, in a mammal caused by the expression of a GSK-3 gene. dsRNA directs the sequence-specific degradation of mRNA through a process known as RNA interference (RNAi).

The dsRNAs of the compositions featured herein include an RNA strand (the antisense strand) having a region which is less than 30 nucleotides in length, generally 19-24 nucleotides in length, and is substantially complementary to at least part of an mRNA transcript of a GSK-3 gene. The use of these dsRNAs enables the targeted degradation of mRNAs of genes that are implicated in replication and or maintenance of cancer cells in mammals. Very low dosages of GSK-3 dsRNAs in particular can specifically and efficiently mediate RNAi, resulting in significant inhibition of expression of the GSK-3 gene. The methods and compositions of the invention containing the GSK-3 dsRNA are useful for treating pathological processes mediated by GSK-3 expression, e.g., manic depression, or other disorders described herein.

The following detailed description discloses how to make and use the compositions containing dsRNAs to inhibit the expression of a GSK-3 gene, as well as compositions and methods for treating diseases and disorders caused by the expression of these genes, such as manic depression. The pharmaceutical compositions featured in the invention include a dsRNA having an antisense strand comprising a region of complementarity which is less than 30 nucleotides in length, generally 19-24 nucleotides in length, and is substantially complementary to at least part of an RNA transcript of a GSK-3 gene, together with a pharmaceutically acceptable carrier. The compositions featured in the invention also include a dsRNA having an antisense strand having a region of complementarity which is less than 30 nucleotides in length, generally 19-24 nucleotides in length, and is substantially complementary to at least part of an RNA transcript of a GSK-3 gene.

Accordingly, certain aspects of the invention provide pharmaceutical compositions containing the GSK-3 dsRNA and a pharmaceutically acceptable carrier, methods of using the compositions to inhibit expression of a GSK-3 gene, and methods of using the pharmaceutical compositions to treat diseases caused by expression of the GSK-3 gene.

I. DEFINITIONS

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "GSK-3" refers to Glycogen Synthase Kinase-3, which is also known as DKFZp686D0638, GSK3, C86142, GSK-3beta, 7330414F15Rik, and 8430431H08Rik. GSK-3 alpha sequence can be found as NCBI GeneID:2931 (human) and 606496 (mouse) and RefSeq ID number:NM_019884 (human) and NM_001031667 (mouse). GSK-3 beta sequence can be found as NCBI GeneID:2932 (human) and 56637 (mouse) and RefSeq ID number:NM_002093 (human) and NM_019827 (mouse). A dsRNA featured in the invention can target a specific GSK-3 isoform, e.g. GSK-3 alpha or GSK-3 beta, or a dsRNA of the invention can target both isoforms by binding to a common region of the mRNA transcript. A dsRNA featured in the invention can target a specific GSK-3 beta isoform, e.g. GSK-3 beta 1 or GSK-3 beta 2, or a dsRNA of the invention can target both isoforms by binding to a common region of the mRNA transcript.

As used herein, "target sequence" refers to a contiguous portion of the nucleotide sequence of an mRNA molecule formed during the transcription of a GSK-3 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the first nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary", "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide which is "substantially complementary to at least part of" a messenger RNA (mRNA) refers to a polynucleotide which is substantially complementary to a contiguous portion of the mRNA of interest (e.g., encoding a GSK-3) including a 5' UTR, an open reading frame (ORF), or a 3' UTR. For example, a polynucleotide is complementary to at least a part of a GSK-3 mRNA if the sequence is substantially complementary to a non-interrupted portion of an mRNA encoding a GSK-3.

The term "double-stranded RNA" or "dsRNA", as used herein, refers to a complex of ribonucleic acid molecules, having a duplex structure comprising two anti-parallel and substantially complementary, as defined above, nucleic acid strands. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims. The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule.

The term "antisense strand" refers to the strand of a dsRNA which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

"Introducing into a cell", when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell", wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection.

The terms "silence" and "inhibit the expression of" "downregulate the expression of," "suppress the expression of" and the like in as far as they refer to a GSK-3 gene, herein refer to the at least partial suppression of the expression of a GSK-3 gene, as manifested by a reduction of the amount of mRNA which may be isolated from a first cell or group of cells in which a GSK-3 gene is transcribed and which has or have been treated such that the expression of a GSK-3 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to GSK-3 gene transcription, e.g., the amount of protein encoded by a GSK-3 gene which is secreted by a cell, or the number of cells displaying a certain phenotype, e.g., apoptosis. In principle, GSK-3 gene silencing may be determined in any cell expressing the target, either constitutively or by genomic engineering, and by any appropriate assay. However, when a reference is needed in order to determine whether a given dsRNA inhibits the expression of the GSK-3 gene by a certain degree and therefore is encompassed by the instant invention, the assay provided in the Examples below shall serve as such reference.

For example, in certain instances, expression of a GSK-3 gene is suppressed by at least about 5%, 10%, 15%, 20%, 25%, 30%, 35%, 40%, 45%, or 50% by administration of the double-stranded oligonucleotide of the invention. In some embodiments, a GSK-3 gene is suppressed by at least about 60%, 70%, or 80% by administration of the double-stranded oligonucleotide of the invention. In some embodiments, a GSK-3 gene is suppressed by at least about 85%, 90%, or 95% by administration of the double-stranded oligonucleotide of the invention.

As used herein in the context of GSK-3 expression, the terms "treat", "treatment", and the like, refer to relief from or alleviation of pathological processes mediated by GSK-3 expression. In the context of the present invention insofar as it relates to any of the other conditions recited herein below (other than pathological processes mediated by GSK-3 expression), the terms "treat", "treatment", and the like mean to relieve or alleviate at least one symptom associated with such condition, or to slow or reverse the progression of such condition, such as the slowing and progression of manic depression.

As used herein, the phrases "therapeutically effective amount" and "prophylactically effective amount" refer to an amount that provides a therapeutic benefit in the treatment, prevention, or management of pathological processes mediated by GSK-3 expression or an overt symptom of pathological processes mediated by GSK-3 expression. The specific amount that is therapeutically effective can be readily determined by ordinary medical practitioner, and may vary depending on factors known in the art, such as, e.g. the type of pathological processes mediated by GSK-3 expression, the patient's history and age, the stage of pathological processes mediated by GSK-3 expression, and the administration of other anti-pathological processes mediated by GSK-3 expression agents.

As used herein, a "pharmaceutical composition" comprises a pharmacologically effective amount of a dsRNA and a pharmaceutically acceptable carrier. As used herein, "pharmacologically effective amount," "therapeutically effective amount" or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a therapeutically effective amount of a drug for the treatment of that disease or disorder is the amount necessary to effect at least a 25% reduction in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

II. DOUBLE-STRANDED RIBONUCLEIC ACID (dsRNA)

As described in more detail herein, the invention provides double-stranded ribonucleic acid (dsRNA) molecules for inhibiting the expression of a GSK-3 gene in a cell or mammal, e.g., in a human having manic depression, or another disorder described herein, where the dsRNA includes an antisense strand having a region of complementarity which is complementary to at least a part of an mRNA formed in the expression of a GSK-3 gene, and where the region of complementarity is less than 30 nucleotides in length, and where said dsRNA, upon contact with a cell expressing a GSK-3 gene, inhibits the expression of a GSK-3 gene, e.g., by at least 30% as assayed by, for example, a PCR or branched DNA (bDNA) based method. The dsRNA of the invention may further include one or more single-stranded nucleotide overhangs.

The dsRNA can be synthesized by standard methods known in the art as further discussed below, e.g., by use of an automated DNA synthesizer, such as are commercially available from, for example, Biosearch, Applied Biosystems, Inc.

The dsRNA includes two RNA strands that are sufficiently complementary to hybridize to form a duplex structure. One strand of the dsRNA (the antisense strand) includes a region of complementarity that is substantially complementary, and generally fully complementary, to a target sequence, derived from the sequence of an mRNA formed during the expression of the GSK-3 gene, the other strand (the sense strand) includes a region that is complementary to the antisense strand, such that the two strands hybridize and form a duplex structure when combined under suitable conditions. Generally, the duplex structure is between 15 and 30, or between 25 and 30, or between 18 and 25, or between 19 and 24, or between 19 and 21, or 19, 20, or 21 base pairs in length. In one embodiment the duplex is 19 base pairs in length. In another embodiment the duplex is 21 base pairs in length. When two different siRNAs are used in combination, the duplex lengths can be identical or can differ.

Similarly, the region of complementarity to the target sequence can be between 15 and 30, or between 25 and 30, or between 18 and 25, or between 19 and 24, or between 19 and 21, or 19, 20, or 21 base pairs in length. In one embodiment the region of complementarity is 19 nucleotides in length. In another embodiment the region of complementarity is 21 nucleotides in length. When two different siRNAs are used in combination, the region of complementarity can be identical or can differ.

Each strand of the dsRNA of invention is generally between 15 and 30, or between 18 and 25, or 18, 19, 20, 21, 22, 23, 24, or 25 nucleotides in length. In other embodiments, each is strand is 25-30 nucleotides in length. Each strand of the duplex can be the same length or of different lengths. When two different siRNAs are used in combination, the lengths of each strand of each siRNA can be identical or can differ.

The dsRNA of the invention can include one or more single-stranded overhang(s) of one or more nucleotides. In one embodiment, at least one end of the dsRNA has a single-stranded nucleotide overhang of 1 to 4, generally 1 or 2 nucleotides. In another embodiment, the antisense strand of the dsRNA has 1-10 nucleotides overhangs each at the 3' end and the 5' end over the sense strand. In further embodiments, the sense strand of the dsRNA has 1-10 nucleotides overhangs each at the 3' end and the 5' end over the antisense strand.

A dsRNAs having at least one nucleotide overhang can have unexpectedly superior inhibitory properties than the blunt-ended counterpart. In some embodiments the presence of only one nucleotide overhang strengthens the interference activity of the dsRNA, without affecting its overall stability. A dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. Such dsRNAs can have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In one embodiment, the targeted GSK-3 gene is the human GSK-3 gene. In another embodiment, the targeted GSK-3 gene is a mouse gene. In some embodiments, the sense strand of the dsRNA includes a sense sequence from Table 1 or Table 2 or Table 4 or Table 5 or Table 6 or Table 7, and the antisense sequence includes an antisense sequence of Table 1 or Table 2 or Table 4 or Table 5 or Table 6 or Table 7. Alternative antisense agents that target elsewhere in the target sequence provided in Table 1 or Table 2 or Table 4 or Table 5 or Table 6 or Table 7 can readily be determined using the target sequence and the flanking GSK-3 sequence.

The skilled person is well aware that dsRNAs comprising a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Table 1 or Table 2 or Table 4 or Table 5 or Table 6 or Table 7, the dsRNAs of the invention can include at least one strand of a length of minimally 21 nt. It can be reasonably expected that shorter dsRNAs having one of the sequences of Table 1 or Table 2 or Table 4 or Table 5 or Table 6 or Table 7 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 1 or Table 2 or Table 4 or Table 5 or Table 6 or Table 7, and differing in their ability to inhibit the expression of a GSK-3 gene in an assay as described herein below by not more than 5, 10, 15, 20, 25, or 30% inhibition from a dsRNA comprising the full sequence, are contemplated by the invention. Further dsRNAs that cleave within the target sequence provided in Table 1 or Table 2 or Table 4 or Table 5 or Table 6 or Table 7 can readily be made using the GSK-3 sequence and the target sequence provided.

In addition, the siRNA agents provided in Table 1 or Table 2 or Table 4 or Table 5 or Table 6 or Table 7 identify a site in a GSK-3 mRNA that is susceptible to siRNA based cleavage. As such the present invention further features siRNA agents that target within the sequence targeted by one of the agents of the present invention. As used herein a second siRNA agent is said to target within the sequence of a first siRNA agent if the second siRNA agent cleaves the message anywhere within the mRNA that is complementary to the antisense strand of the first siRNA agent. Such a second agent will generally consist of at least 15 contiguous nucleotides from one of the sequences provided in Table 1 or Table 2 or Table 4 or Table 5 or Table 6 or Table 7 coupled to additional nucleotide sequences taken from the region contiguous to the selected sequence in the GSK-3 gene. For example, the last 15 nucleotides of SEQ ID NO:1 combined with the next 6 nucleotides from the target GSK-3 gene produces a single strand agent of 21 nucleotides that is based on one of the sequences provided in Table 1 or Table 2 or Table 4 or Table 5 or Table 6 or Table 7.

The dsRNA of the invention can contain one or more mismatches to the target sequence. In a preferred embodiment, the dsRNA of the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of the GSK-3 gene, the dsRNA generally does not contain any mismatch within the central 13 nucleotides. The methods described within the invention can be used to determine whether a dsRNA containing a mismatch to a target sequence is effective in inhibiting the expression of a GSK-3 gene. Consideration of the efficacy of dsRNAs with mismatches in inhibiting expression of a GSK-3 gene is important, especially if the particular region of complementarity in a GSK-3 gene is known to have polymorphic sequence variation within the population.

In some embodiments the sense and/or antisense sequences of the dsRNA molecules featured herein can have the primary sequence shown in the tables with or without the modifications shown in the tables. In other embodiments the dsRNA molecule can differ by not more than 1, 2 or 3 bases from that provided in the tables.

In one embodiment, at least one end of the dsRNA has a single-stranded nucleotide overhang of 1 to 4, generally 1 or 2 nucleotides. dsRNAs having at least one nucleotide overhang have superior inhibitory properties than their blunt-ended counterparts. The presence of only one nucleotide overhang strengthens the interference activity of the dsRNA, without affecting its overall stability. dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA may also have a blunt end, generally located at the 5'-end of the antisense strand. Such dsRNAs have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

Modifications

In yet another embodiment, the dsRNA is chemically modified to enhance stability. The nucleic acids of the invention may be synthesized and/or modified by methods well established in the art, such as those described in "Current protocols in nucleic acid chemistry", Beaucage, S. L. et al. (Edrs.), John Wiley & Sons, Inc., New York, N.Y., USA, which is hereby incorporated herein by reference. Specific examples of preferred dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Preferred modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Preferred modified dsRNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other preferred dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, an dsRNA mimetic that has been shown to have excellent hybridization properties, is referred to as a peptide nucleic acid (PNA). In PNA compounds, the sugar backbone of an dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

Most preferred embodiments of the invention are dsRNAs with phosphorothioate backbones and oligonucleosides with heteroatom backbones, and in particular —$CH_2$—NH—

CH₂—, —CH₂—N(CH₃)—O—CH₂—[known as a methylene (methylimino) or MMI backbone], —CH₂—O—N(CH₃)—CH₂—, —CH₂—N(CH₃)—N(CH₃)—CH₂— and —N(CH₃)—CH₂—CH₂— [wherein the native phosphodiester backbone is represented as —O—P—O—CH₂—] of the above-referenced U.S. Pat. No. 5,489,677, and the amide backbones of the above-referenced U.S. Pat. No. 5,602,240. Also preferred are dsRNAs having morpholino backbone structures of the above-referenced U.S. Pat. No. 5,034,506.

Modified dsRNAs may also contain one or more substituted sugar moieties. Preferred dsRNAs comprise one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are O[(CH₂)ₙO]ₘCH₃, O(CH₂)ₙOCH₃, O(CH₂)ₙNH₂, O(CH₂)ₙCH₃, O(CH₂)ₙONH₂, and O(CH₂)₂ON[(CH₂)ₙCH₃)]₂, where n and m are from 1 to about 10. Other preferred dsRNAs comprise one of the following at the 2' position: $C_1$ to $C_{10}$ lower alkyl, substituted lower alkyl, alkaryl, aralkyl, O-alkaryl or O-aralkyl, SH, SCH₃, OCN, Cl, Br, CN, CF₃, OCF₃, SOCH₃, SO₂CH₃, ONO₂, NO₂, N₃, NH₂, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. A preferred modification includes 2'-methoxyethoxy (2'-O—CH₂CH₂OCH₃, also known as 2'-O-(2-methoxyethyl) or 2'-MOE) (Martin et al., Helv. Chim. Acta, 1995, 78, 486-504) i.e., an alkoxy-alkoxy group. A further preferred modification includes 2'-dimethylaminooxyethoxy, i.e., a O(CH₂)₂ON(CH₃)₂ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH₂—O—CH₂—N(CH₂)₂, also described in examples herein below.

Other preferred modifications include 2'-methoxy (2'-OCH₃), 2'-aminopropoxy (2'-OCH₂CH₂CH₂NH₂) and 2'-fluoro (2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

DsRNAs may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., DsRNA Research and Applications, CRC Press, Boca Raton, 1993, pp. 276-278) and are presently preferred base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; and 5,681,941, each of which is herein incorporated by reference, and U.S. Pat. No. 5,750,692, also herein incorporated by reference.

Conjugates

Another modification of the dsRNAs of the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acid. Sci. USA, 199, 86, 6553-6556), cholic acid (Manoharan et al., Biorg. Med. Chem. Let., 1994 4 1053-1060), a thioether, e.g., beryl-S-tritylthiol (Manoharan et al., Ann. N.Y. Acad. Sci., 1992, 660, 306-309; Manoharan et al., Biorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J, 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyloxycholesterol moiety (Crooke et al., J. Pharmacol. Exp. Ther., 1996, 277, 923-937).

Representative U.S. patents that teach the preparation of such dsRNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

It is not necessary for all positions in a given compound to be uniformly modified, and in fact more than one of the aforementioned modifications may be incorporated in a single compound or even at a single nucleoside within an dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of an dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-5-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

Vector Encoded siRNA Agents

In another aspect of the invention, GSK-3 specific dsRNA molecules that are expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054, 299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., Proc. Natl. Acad. Sci. USA (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In a preferred embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., Curr. Topics Micro. Immunol. (1992) 158:97-129)); adenovirus (see, for example, Berkner, et al., BioTechniques (1998) 6:616), Rosenfeld et al. (1991, Science 252:431-434), and Rosenfeld et al. (1992), Cell 68:143-155)); or alphavirus as well as others known in the art. Retroviruses have been used to introduce a variety of genes into many different cell types, including epithelial cells, in vitro and/or in vivo (see, e.g., Eglitis, et al., Science (1985) 230:1395-1398; Danos and Mulligan, Proc. Natl. Acad. Sci. USA (1998) 85:6460-6464; Wilson et al., 1988, Proc. Natl. Acad. Sci. USA 85:3014-3018; Armentano et al., 1990, Proc. Natl. Acad. Sci. USA 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beusechem. et al., 1992, Proc. Nad. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), *J Virol* 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), *Gene Therap.* 2: 301-310; Eglitis M A (1988), *Biotechniques* 6: 608-614; Miller A D (1990), *Hum Gene Therap.* 1: 5-14; Anderson W F (1998), *Nature* 392: 25-30; and Rubinson D A et al., *Nat. Genet.* 33: 401-406, the entire disclosures of which are herein incorporated by reference.

Preferred viral vectors are those derived from AV and AAV. In a particularly preferred embodiment, the dsRNA of the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA of the invention, a method for constructing the recombinant AV vector, and a method for delivering the vector into target cells, are described in Xia H et al. (2002), *Nat. Biotech.* 20: 1006-1010.

Suitable AAV vectors for expressing the dsRNA of the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

The promoter driving dsRNA expression in either a DNA plasmid or viral vector of the invention may be a eukaryotic RNA polymerase I (e.g. ribosomal RNA promoter), RNA polymerase II (e.g. CMV early promoter or actin promoter or U1 snRNA promoter) or generally RNA polymerase III promoter (e.g. U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, *Proc. Natl. Acad. Sci. USA* 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, *FASEB J.* 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g. Oligofectamine) or non-cationic lipid-based carriers (e.g. Transit-TKO™). Multiple lipid transfections for dsRNA-mediated knockdowns targeting different regions of a single GSK-3 gene or two GSK-3 genes over a period of a week or more are also contemplated by the invention. Successful introduction of the vectors of the invention into host cells can be monitored using various known methods. For example, transient transfection. can be signaled with a reporter, such as a fluorescent marker, such as Green Fluorescent Protein (GFP). Stable transfection of ex vivo cells can be ensured using markers that provide the transfected cell with resistance to specific environmental factors (e.g., antibiotics and drugs), such as hygromycin B resistance.

The GSK-3 specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. PHARMACEUTICAL COMPOSITIONS COMPRISING dsRNA

In one embodiment, the invention provides pharmaceutical compositions comprising a dsRNA, as described herein, and a pharmaceutically acceptable carrier. The pharmaceutical composition comprising the dsRNA is useful for treating a disease or disorder associated with the expression or activity of a GSK-3 gene, such as pathological processes mediated by GSK-3 expression. Such pharmaceutical compositions are formulated based on the mode of delivery. One example is compositions that are formulated for systemic administration via parenteral delivery.

The pharmaceutical compositions featured herein are administered in dosages sufficient to inhibit expression of a GSK-3 gene. In general, a suitable dose of dsRNA will be in the range of 0.01 to 200.0 milligrams per kilogram body weight of the recipient per day, generally in the range of 1 to 50 mg per kilogram body weight per day. For example, the dsRNA can be administered at 0.01 mg/kg, 0.05 mg/kg, 0.5 mg/kg, 1 mg/kg, 1.5 mg/kg, 2 mg/kg, 3 mg/kg, 5.0 mg/kg, 10 mg/kg, 20 mg/kg, 30 mg/kg, 40 mg/kg, or 50 mg/kg per single dose.

The pharmaceutical composition may be administered once daily or the dsRNA may be administered as two, three, or more sub-doses at appropriate intervals throughout the day or even using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by GSK-3 expression. Such models are used for in vivo testing of dsRNA, as well as for determining a therapeutically effective dose.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

The dsRNAs featured in the invention can be administered in combination with other known agents effective in treatment of pathological processes mediated by target gene expression. In any event, the administering physician can adjust the amount and timing of dsRNA administration on the basis of results observed using standard measures of efficacy known in the art or described herein.

Administration

The present invention also includes pharmaceutical compositions and formulations which include the dsRNA compounds of the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration. In one embodiment, the pharmaceutical composition is administered intracranially, directly into the nucleus accumbens.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Preferred topical formulations include those in which the dsRNAs of the invention are in admixture with a topical delivery agent such as lipids, liposomes, fatty acids, fatty acid esters, steroids, chelating agents and surfactants. Preferred lipids and liposomes include neutral (e.g. dioleoylphosphatidyl DOPE ethanolamine, dimyristoylphosphatidyl choline DMPC, distearolyphosphatidyl choline) negative (e.g. dimyristoylphosphatidyl glycerol DMPG) and cationic (e.g. dioleoyltetramethylaminopropyl DOTAP and dioleoylphosphatidyl ethanolamine DOTMA). DsRNAs of the invention may be encapsulated within liposomes or may form complexes thereto, in particular to cationic liposomes. Alternatively, dsRNAs may be complexed to lipids, in particular to cationic lipids. Preferred fatty acids and esters include but are not limited arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g. isopropylmyristate IPM), monoglyceride, diglyceride or pharmaceutically acceptable salt thereof. Topical formulations are described in detail in U.S. patent application Ser. No. 09/315, 298 filed on May 20, 1999 which is incorporated herein by reference in its entirety.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Preferred oral formulations are those in which dsRNAs of the invention are administered in conjunction with one or more penetration enhancers surfactants and chelators. Preferred surfactants include fatty acids and/or esters or salts thereof, bile acids and/or salts thereof. Preferred bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Preferred fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g. sodium). Also preferred are combinations of penetration enhancers, for example, fatty acids/salts in combination with bile acids/salts. A particularly preferred combination is the sodium salt of lauric acid, capric acid and UDCA. Further penetration enhancers include polyoxyethylene-9-lauryl ether, polyoxyethylene-20-cetyl ether. DsRNAs of the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Particularly preferred complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g. p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. application. Ser. No. 08/886,829 (filed Jul. 1, 1997), Ser. No. 09/108,673 (filed Jul. 1, 1998), Ser. No. 09/256,515 (filed Feb. 23, 1999), Ser. No. 09/082,624 (filed May 21, 1998) and Ser. No. 09/315,298 (filed May 20, 1999), each of which is incorporated herein by reference in their entirety.

Compositions and formulations for parenteral, intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Emulsions

The compositions of the present invention may be prepared and formulated as emulsions. Emulsions are typically heterogenous systems of one liquid dispersed in another in the form of droplets usually exceeding 0.1 µm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., *Pharmaceutical Research*, 1994, 11, 1385-1390; Ritschel, *Meth. Find. Exp. Clin. Pharmacol.*, 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., *Pharmaceutical Research*, 1994, 11, 1385; Ho et al., *J. Pharm. Sci.*, 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., *Critical Reviews in Therapeutic Drug Carrier Systems*, 1991, p. 92). Each of these classes has been discussed above.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun, 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P.Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Ilium et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, a dsRNA featured in the invention is fully encapsulated in the lipid formulation to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA) or analogs thereof, or a mixture thereof. The cationic lipid may comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C|_8$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In one embodiment, the lipidoid ND98.4HCl (MW 1487) (Formula 1), Cholesterol (Sigma-Aldrich), and PEG-Ceramide C16 (Avanti Polar Lipids) can be used to prepare lipid-siRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous siRNA (e.g., in sodium acetate pH 5) such that the final ethanol concentration is about 35-45% and the final sodium acetate concentration is about 100-300 mM. Lipid-siRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

In one embodiment, the lipid-dsRNA particle includes 40 mol % 2-Dilinoleyl-4-dimethylaminoethyl-[1,3]-dioxolane, 10 mol % 1,2-distearoyl-sn-glycero-3-phosphocholine (DSPC), 40 mol % Cholesterol, 10 mol % PEG-C-DOMG with a particle size of 63.0±20 nm and a 0.027 dsRNA/Lipid Ratio.

In another embodiment, the lipid-dsRNA particle includes 40 mol % 1,2-dilinoleyloxy-N,N-dimethyl-3-aminopropane (DLinDMA), 10 mol % 1,2-distearoyl-sn-glycero-3-phosphocholine (DSPC), 2 mol % 3-N-[(qmethoxypoly(ethylene glycol)2000)carbamoyl]-1,2-dimyristyloxy-propylamine (PEG-C-DMA), and 48 mol % cholesterol.

Formula 1

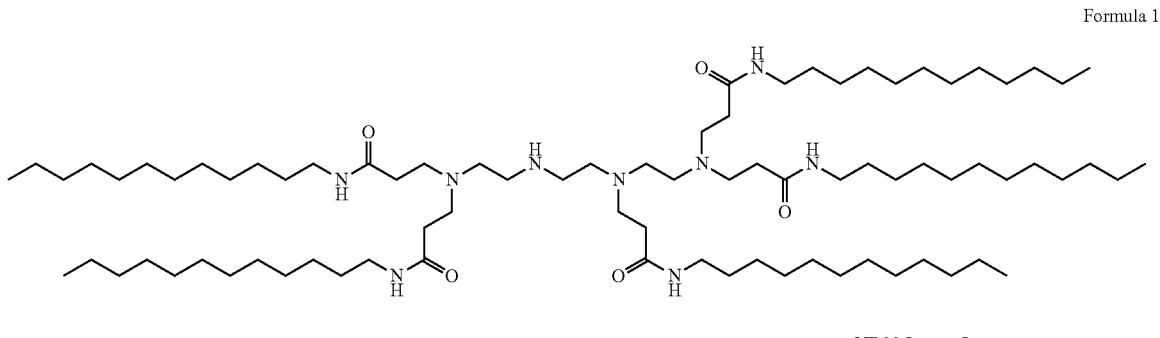

ND98 Isomer I

LNP01 formulations are described, e.g., in International Application Publication No. WO 2008/042973, which is hereby incorporated by reference.

As mentioned above, the lipid-dsRNA particle can comprise a cationic lipid, a neutral lipid, a steroid, and optionally a lipid that prevents aggregation of the particle. The relative percentages of these constituents can vary depending on the type of lipids used. However, in general, the cationic lipid comprises from about 20 mol % to about 70 mol % or about 40 mol % to about 60 mol % of the total lipid present in the particle; neutral lipids comprise from about 5 mol % to about 90 mol %, about 10 mol %, or about 58 mol % if cholesterol is included, of the total lipid present in the particle; the steroid (typically cholesterol) can comprise from about 10 mol % to about 60 mol % or about 48 mol % of the total lipid present in the particle; finally, the lipid that prevents aggregation of the particle, typically a conjugated lipid (e.g., a PEG-conjugated lipid) can comprise from 0 mol % to about 20 mol % or about 2 mol % of the total lipid present in the particle.

In another embodiment, the lipid-dsRNA particle includes 57.1 mol % 1,2-Dilinolenyloxy-N,N-dimethylaminopropane (DLinDMA), 7.1 mol % DPPC, 34.4 mol % Cholesterol, 1.4 mol % PEG-cDMA.

In another embodiment, the lipid-dsRNA particle includes 48 mol % cholesterol, 20 mol % of the neutral lipid 1,2-distearoyl-sn-glycero-3-phosphocholine, 2 mol % of PEG-cDMA (3-N-[(methoxy poly(ethylene glycol)2000)carbamoyl]-1,2-dimyrestyloxypropylamine), and 30 mol % of the cationic lipid DLinDMA (1,2-dilinoleyloxy-3-(N,N-dimethyl)aminopropane).

In another embodiment, the lipid-dsRNA particle includes 48 mol % cholesterol, 20 mol % of the neutral lipid 1,2-distearoyl-sn-glycero-3-phosphocholine, 2 mol % of PEG-cDMA (3-N-[(methoxy poly(ethylene glycol)2000)carbamoyl]-1,2-dimyrestyloxypropylamine), and 30 mol % of the cationic lipid 2,2-Dilinoleyl-4-dimethylaminoethyl-[1,3]-dioxolane.

Additional exemplary lipid-siRNA formulations are as follows:

| | Cationic Lipid | cationic lipid/non-cationic lipid//choleseterol/PEG-lipid conjugate Lipid:siRNA ratio | Process |
|---|---|---|---|
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 6:1 | Extrusion |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 11:1 | Extrusion |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 6:1 | In-line mixing |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 11:1 | In-line mixing |

-continued

| Cationic Lipid | | cationic lipid/non-cationic lipid//choleseterol/PEG-lipid conjugate Lipid:siRNA ratio | Process |
|---|---|---|---|
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 | In-line mixing |
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~ 7:1 | |
| SNALP-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~ 7:1 | |

Characterization of Lipid Formulated dsRNAs

Formulations prepared by either the in-line mixing or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano Z S (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., *Critical Reviews in Therapeutic Drug Carrier Systems*, 1991, p. 92). Each of the above mentioned classes of penetration enhancers are described below in greater detail.

Surfactants:

In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in *Therapeutic Drug Carrier Systems,* 1991, p. 92); and perfluorochemical emulsions, such as FC-43. Takahashi et al., *J. Pharm. Pharmacol.,* 1988, 40, 252).

Fatty Acids:

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C.sub.1-10 alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., *Critical Reviews in Therapeutic Drug Carryier Systems,* 1991, p. 92; Muranishi, *Critical Reviews in Therapeutic Drug Carrier Systems,* 1990, 7, 1-33; El Hariri et al., *J. Pharm. Pharmacol.,* 1992, 44, 651-654).

Bile Salts:

The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. The bile salts of the invention include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., *Critical Reviews in Therapeutic Drug Carrier Systems,* 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, *Critical Reviews in Therapeutic*

*Drug Carrier Systems,* 1990, 7, 1-33; Yamamoto et al., *J. Pharm. Exp. Ther.,* 1992, 263, 25; Yamashita et al., *J. Pharm. Sci.,* 1990, 79, 579-583).

Chelating Agents:

Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, *J. Chromatogr.,* 1993, 618, 315-339). Chelating agents of the invention include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., *Critical Reviews in Therapeutic Drug Carrier Systems,* 1991, page 92; Muranishi, *Critical Reviews in Therapeutic Drug Carrier Systems,* 1990, 7, 1-33; Buur et al., *J. Control Rel.,* 1990, 14, 43-51).

Non-Chelating Non-Surfactants:

As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, *Critical Reviews in Therapeutic Drug Carrier Systems,* 1990, 7, 1-33). This class of penetration enhancers include, for example, unsaturated cyclic ureas, 1-alkyl- and 1-alkenylazacyclo-alkanone derivatives (Lee et al., *Critical Reviews in Therapeutic Drug Carrier Systems,* 1991, page 92); and non-steroidal anti-inflammatory agents such as diclofenac sodium, indomethacin and phenylbutazone (Yamashita et al., *J. Pharm. Pharmacol.,* 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4' isothiocyano-stilbene-2,2'-disulfonic acid (Miyao et al., *DsRNA Res. Dev.,* 1995, 5, 115-121; Takakura et al., *DsRNA & Nucl. Acid Drug Dev.,* 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipient suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

Certain embodiments of the invention provide pharmaceutical compositions containing (a) one or more antisense compounds and (b) one or more other chemotherapeutic agents which function by a non-antisense mechanism. Examples of such chemotherapeutic agents include but are not limited to daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphor-amide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). See, generally, The Merck Manual of Diagnosis and Therapy, 15th Ed. 1987, pp. 1206-1228, Berkow et al., eds., Rahway, N.J. When used with the compounds of the invention, such chemotherapeutic agents may be used individually (e.g., 5-FU and oligonucleotide), sequentially (e.g., 5-FU and oligonucleotide for a period of time followed by MTX and oligonucleotide), or in combination with one or more other such chemotherapeutic agents (e.g., 5-FU, MTX and oligonucleotide, or 5-FU, radiotherapy and oligonucleotide). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. See, generally, The Merck Manual of Diagnosis and Therapy, 15th Ed., Berkow et al., eds., 1987, Rahway, N.J., pages 2499-2506 and 46-49, respectively). Other non-antisense chemotherapeutic agents are also within the scope of this invention. Two or more combined compounds may be used together or sequentially.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred.

The data obtained from cell culture assays and animal studies can be used in formulation a range of dosage for use in humans. The dosage of compositions of the invention lies generally within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by GSK-3 expression. In any event, the administering physician can adjust the amount and timing of dsRNA administration on the basis of results observed using standard measures of efficacy known in the art or described herein.

Methods for Treating Diseases Caused by Expression of a GSK-3 Gene

The invention relates in particular to the use of a dsRNA targeting GSK-3 and compositions containing at least one such dsRNA, for the treatment of a GSK-3-mediated disorder or disease. For example, a dsRNA targeting a GSK-3 gene can be useful for the treatment of manic depression.

Other disorders which can be treated with the compounds, compositions and methods described herein include a metabolic disease, such as metabolic disorders (e.g., Type I or Type II diabetes or metabolic syndrome) and nervous system disorders, (e.g., CNS or nuerogenerative disorders (e.g., Alzheimer's disease, Parkinson's disease, Huntington's Disease, prion diseases (e.g., transmissible spongiform encephalopathies), stroke and schizophrenia). Compositions and methods for treating pathological conditions and diseases such as protozoan diseases (e.g., *Plasmodium falciparum*), cancer (e.g., colorectal cancer), and circadian rhythm diseases (e.g., sleep disorders, jet lag, and shift work), and are also provided. The dsRNAs described here can also be used to regulate skeletal muscle growth, inflammatory responses, platelet function, apoptosis, and cellular responses to DNA damage.

"Metabolic syndrome" is characterized by a group of metabolic risk factors including: abdominal obesity (excessive fat tissue in and around the abdomen), atherogenic dyslipidemia (blood fat disorders (including high triglycerides, low HDL cholesterol and high LDL cholesterol) that foster plaque build-up in artery walls), elevated blood pressure, insulin resistance or glucose intolerance (due to the body's inability to properly use insulin or blood sugar), a prothrombotic state (e.g., high fibrinogen or plasminogen activator inhibitor-1 in the blood), and a proinflammatory state (e.g., elevated C-reactive protein in the blood). People with metabolic syndrome are at increased risk of coronary heart disease and other diseases related to plaque buildups in artery walls (e.g., stroke and peripheral vascular disease), and Type II diabetes. Other metabolic diseases suitable for treatment with a dsRNA targeting GSK-3 include obesity and insulin resistance.

A dsRNA targeting GSK-3 can be also be useful for the treatment of cancer, such as a colorectal cancer.

A composition containing a dsRNA targeting GSK-3 may also be used to treat other tumors and cancers, such as breast cancer, lung cancer, head and neck cancer, brain cancer, abdominal cancer, colon cancer, colorectal cancer, esophagus cancer, gastrointestinal cancer, glioma, tongue cancer, neuroblastoma, osteosarcoma, ovarian cancer, pancreatic cancer, prostate cancer, retinoblastoma, Wilm's tumor, multiple myeloma and for the treatment of skin cancer, like melanoma, for the treatment of lymphomas and blood cancer.

Owing to the inhibitory effects on GSK-3 expression, a composition according to the invention or a pharmaceutical composition prepared therefrom can enhance the quality of life.

The invention further relates to the use of a dsRNA or a pharmaceutical composition thereof, e.g., for treating manic depression or another disorder described herein, in combination with other pharmaceuticals and/or other therapeutic methods, e.g., with known pharmaceuticals and/or known therapeutic methods, such as, for example, those which are currently employed for treating these disorders.

For example, in the treatment of manic depression, the patient can also be treated with one or more other therapeutic modalities, e.g., lithium salts, anticonvulsant mood stabilizers, antipsychotics, and other adjunctive treatments described herein. In an embodiment the patient is also treated with lithium salts. Lithium salts have been used as a first-line treatment for bipolar disorder. Common lithium salts are lithium carbonate and (probably less commonly) lithium citrate. Lithium orotate is used as an alternative treatment to lithium carbonate by some individuals with bipolar disorder. In an embodiment the patient is also treated with an anticonvulsant mood stabilizer. Anticonvulsant medications, particularly valproate and carbamazepine, have been used as alternatives or adjuncts to lithium in many cases. Valproate (Depakote, Epival) was FDA approved for the treatment of acute mania in 1995, and is now considered by some doctors to be the first line of therapy for bipolar disorder. A similar medication, valproic acid (Depakene) is also used. Anticonvulsants are also used in combination with antipsychotics. Newer anticonvulsant medications, including lamotrigine and oxcarbazepine, are also effective as mood stabilizers in bipolar disorder. Lamotrigine is particularly promising, as it alleviates bipolar depression and prevents recurrence at higher rates. Zonisamide (trade name Zonegran), another anticonvulsant, also may show promise in treating bipolar depression. Topiramate maybe useful for some patients. It appears to be useful in some treatment resistant cases and for anxiety issues when clonazepam cannot be prescribed. Other anticonvulsants effective in some cases and under study include phenyloin, levetiracetam, pregabalin and valnoctamide. In an embodiment the patient is also treated with an "atypical antipsychotic drug." The newer atypical antipsychotic drugs such as risperidone, quetiapine, and olanzapine are often used in acutely manic patients. In light of recent evidence, olanzapine (Zyprexa) has been FDA approved as an effective monotherapy for the maintenance of bipolar disorder. Eli Lilly and Company also offers Symbyax, a combination of olanzapine and fluoxetine. Ziprasidone (Geodon) and aripriprazole (Abilify) also show promise. Other newer treatments include Modafinil (Provigil) and Pramipexole (Mirapex), which show promise in treating the cognitive deterioration related to bipolar depression. In addition Riluzole, an ALS treatment, has been shown to be effective treatment. The breast cancer medicine tamoxifen has shown quick response to manic phases. In an embodiment the patient is also treated with electroconvulsive therapy. Electroconvulsive therapy (ECT) is sometimes used to treat severe bipolar depression in cases where other treatments have failed and is 60 to 70 percent effective. In an embodiment the patient is also treated with psychotherapy. Other treatments include omega-3 fatty acids, particularly as a supplement to other medication. There are also reports that medical marijuana can help control the mood swings in some forms of bipolar disorder.

In an embodiment a dsRNA described herein is administered to a patient who has previously been treated with another therapeutic or counseling modality but which has provided less than optimal results.

In the example of a metabolic disorder, e.g., diabetes, the patient can also be provided administration of a dsRNA targeting GSK-3 can be accompanied by a exercise regimen or by dietary restrictions. A dsRNA featured in the invention can also be administered with a drug or combination of drugs for managing Type II diabetes, e.g., a sulfonylurea, a biguanide, an alpha-glucosidase inhibitor, a thiazolidinedione, a meglitinide, a D-phenylalanine derivative, an amylin synthetic derivatives, an incretin mimetic, or an insulin. Exemplary insulins include regular insulins (Humulin®, Novolin®), insulin lispro (Humalog®), insulin aspart (Novolog®), insulin glulisine (Apidra®), prompt insulin zinc (Semilente®, slightly slower acting), inhaled insulin (Exubera®), intermediate-acting insulins, isophane insulin, neutral protamine Hagedorn (NPH), insulin zinc (Lente®), extended insulin zinc insulin (Ultralente®), insulin glargine (Lantus®), and insulin detemir (Levemir®).

In the example of cancer the patient can also be provided with a chemotherapy agent, such as deoxycoformycin, cisplatin, cyclophosphamide, 5-fluorouracil, adriamycin, daunorubicin, tamoxifen aunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). See, generally, The Merck Manual of Diagnosis and Therapy, 15th Ed. 1987, pp. 1206-1228, Berkow et al., eds., Rahway, N.J. When used with the dsRNAs featured in the invention, such chemotherapeutic agents may be used individually (e.g., deoxycoformycin and dsRNA), sequentially (e.g., antiviral and dsRNA for a period of time, followed by deoxycoformycin and dsRNA), or in combination with one or more other such agents (e.g., deoxycoformycin, antiviral and dsRNA, or deoxycoformycin, radiotherapy and dsRNA). Two or more combined compounds may be used together or sequentially.

Generally, the dsRNAs described here can be used in combination with other GSK-3 inhibitors. Examples of such inhibitors described in Meijer et al., *Trends in Pharmacological Sciences*, 25: 471 (September 2004), incorporated herein by reference include pyrroloazepines, (e.g., hymenialdisine), flavones (e.g., flavopiridol), benzazepinones (e.g., kenpaullone, alsterpaulione, and azakenpaullone), bis-indole indirubin-3'-oximes (e.g., indirubin-3'-oxime, 6-bromoindirubin-3'-oxime (BIO), and 6-bromoindirubin-3'-acetoxime), pyrrolopyrazines (e.g., aloisine A and aloisine B), thiadiazolidinones (e.g., TDZD8), pyridyloxadiazoles (e.g., Compound 12), pyrazolopyridines (e.g., pyrazolopyridine 18 and pyrazolopyridine 34), pyrazolopyridazines (e.g., pyrazolopyridine 9), aminopyrimidines (e.g., CHIR98014 and CHIR99021 (CT99021)), pyrazoloquinoxalines (Compound 1), oxindoles (indolinones) (e.g., SU9516), thiazoles (e.g., ARA014418), bisindolylmaleimides (e.g., staurosporine and Compound 5a), azaindolylmaleimides (e.g., Compound 29 and Compound 46), bisindolylmaleimides (e.g., GF109203x (bisindolylmaleimide I) and Ro318220 (bisindolylmaleimide IX)), arylindolemaleimides (e.g., SB216763), anilinomaleimides (e.g., SB415286), anilinoarylmaleimides (e.g., I5), phenylaminopyrimidines (e.g., CGP60474), triazoles (e.g., Compound 8b), pyrrolopyrimidines (e.g., TWS119), pyrazolopyrimidines (e.g., Compound 1A), chloromethyl thienyl ketone (e.g., Compound 17), atoms in competition with $Mg^{2+}$ (e.g., lithium), atoms in competition with $Mg^{2+}$ and ATP (e.g., beryllium), and uncompetitive atoms (e.g., zinc). Structures for some of the inhibitors can be found in FIG. 2 of Meijer et al. and are shown below.

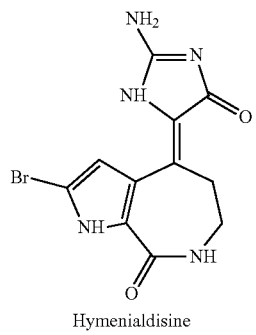

Hymenialdisine

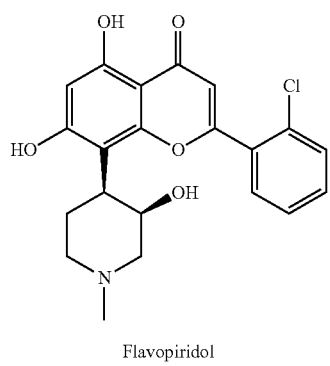

Flavopiridol

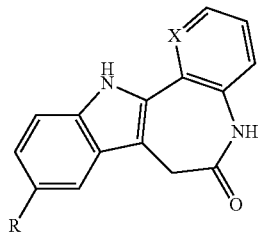

Paullone (R = H; X = C)
Kerpaullone (R = Br; X = C)
Alaterpaullone (R = NO$_2$; X = C)
Azakenpaullone (R = Br; X = N)

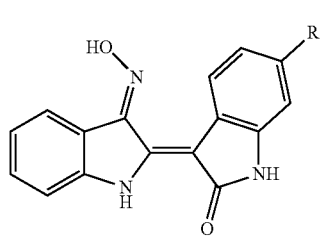

Indirubin-3'-oxime (R = H)
BIO (R = Br)

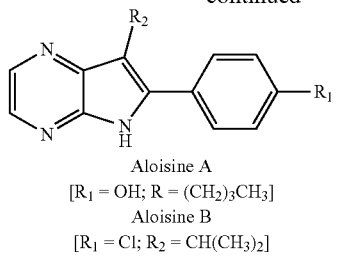

Aloisine A
[R$_1$ = OH; R = (CH$_2$)$_3$CH$_3$]
Aloisine B
[R$_1$ = Cl; R$_2$ = CH(CH$_3$)$_2$]

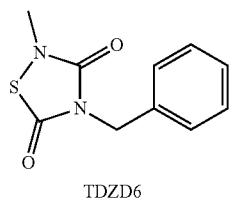

TDZD6

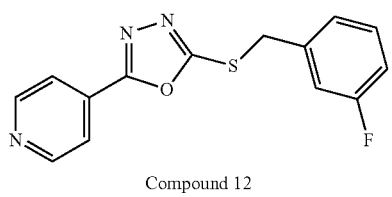

Compound 12

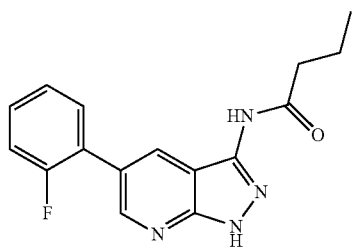

Pyraxolopyridine 18

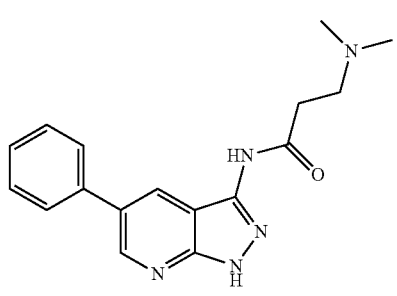

Pyraxolopyridine B

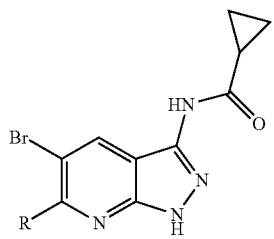

Pyraxolopyridine 34
(R = 2-furyl)

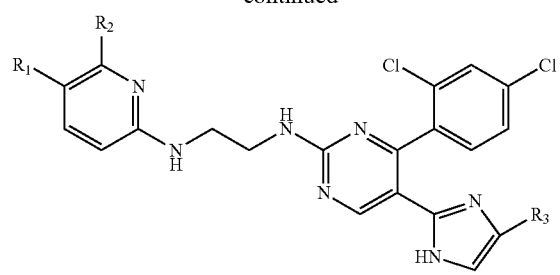
CHIR98014
($R_1$ = NO; $R_2$ = NH$_2$; $R_3$ = H)
CHIR99021
($R_1$ = CN; $R_2$ = H; $R_3$ = CH$_3$)
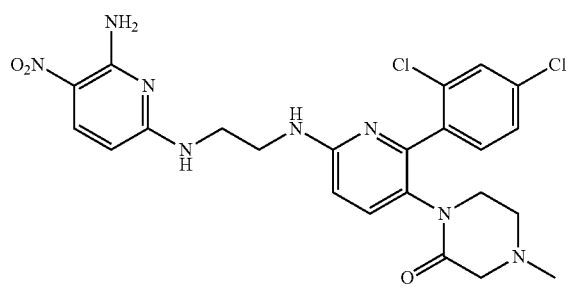
CT20026
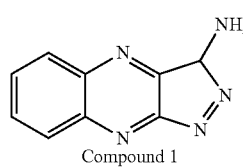
Compound 1
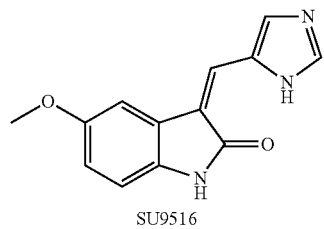
SU9516
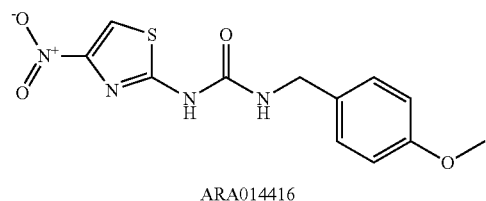
ARA014416
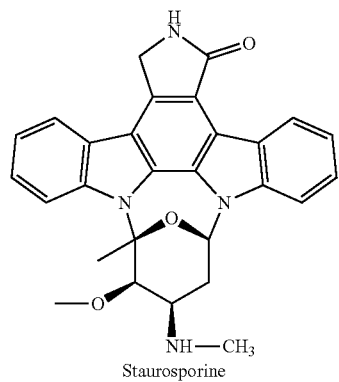
Staurosporine
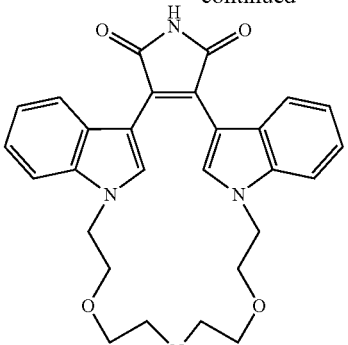
Compound 5a
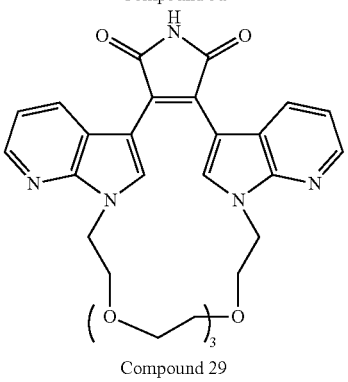
Compound 29
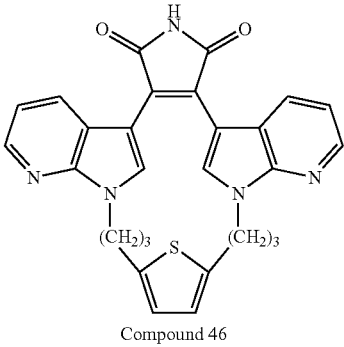
Compound 46
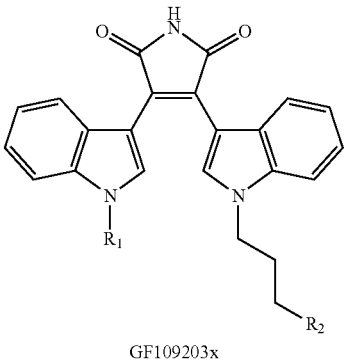
GF109203x
[$R_1$ = H; $R_2$ = N(CH$_3$)$_2$]
Ro318220
[$R_1$ = CH$_3$; $R_2$ = S-C(NH)-NH$_2$]

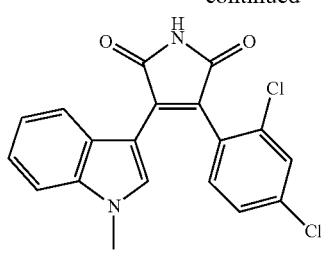
SB16763

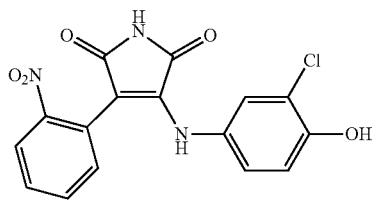
SB415286

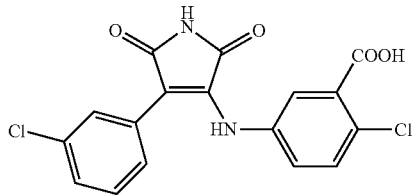
I5

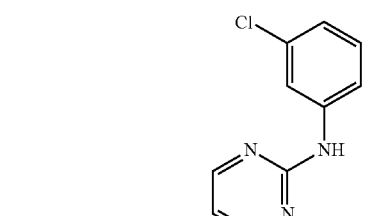
CGP60474

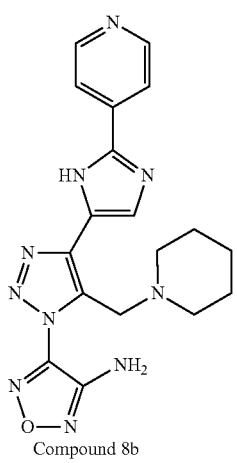
Compound 8b

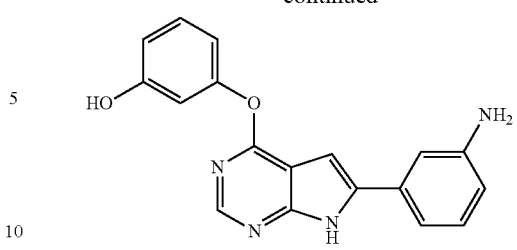
TWS119

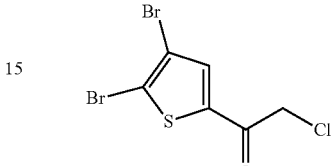
Compound 17

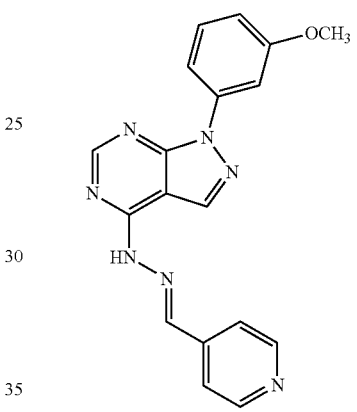
Compound 1A

Methods for Inhibiting Expression of the GSK-3 Gene

In yet another aspect, the invention provides a method for inhibiting the expression of an GSK-3 gene in a mammal. The method includes administering a composition featured in the invention to the mammal such that expression of the target GSK-3 gene is silenced.

When the organism to be treated is a mammal such as a human, the composition may be administered by any means known in the art including, but not limited to oral or parenteral routes, including intravenous, intramuscular, subcutaneous, transdermal, airway (aerosol), nasal, rectal, and topical (including buccal and sublingual) administration. In preferred embodiments, the compositions are administered by intravenous infusion or injection.

Unless otherwise defined, all technical and scientific terms used herein have the same meaning as commonly understood by one of ordinary skill in the art to which this invention belongs. Although methods and materials similar or equivalent to those described herein can be used in the practice or testing of the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLE

Example 1

Design and Synthesis of siRNA Targeting GSK3 siRNA Design for Mouse Glycogen Synthase Kinase 3 Alpha (GSK3α)

All possible perfect match sense 19mer oligomers were extracted from mouse GSKalpha sequence NM_001031667.1, the sole NCBI reference sequence for the mouse GSK3α gene, and identified as candidate target regions. The sequences are shown in Table 1 below.

In order to rank candidate target sequences and their corresponding siRNAs and select appropriate ones, their predicted potential for interacting with irrelevant targets (off-target potential) was taken as the primary ranking parameter. siRNAs with low off-target potential were defined as preferable and assumed to be more specific in vivo.

To identify potential off-target genes, 19mer candidate sequences as well as their 19mer reverse complements were subjected to a homology search against the entire NCBI mouse reference mRNA sequence collection using the FASTA search algorithm (Pearson, W R, Lipman, D J. Improved Tools for Biological Sequence Comparison. PNAS (1988) 85: 2444-8.).

The following off-target properties for every 19mer were extracted for each oligo-mouse transcript alignment to calculate the off-target score:
1. Number of mismatches in seed region, defined as positions 2-9 of the oligomer
2. Number of mismatches in cleavage site region, defined as positions 10 and 11
3. Number of mismatches in non-seed region, non-cleavage region, defined as positions 12-19
4. Mismatches in position 1 were ignored The off-target score for each oligo-transcript pair was calculated for considering assumptions 1 to 3 as follows:

Off-target score=(number of seed mismatches*2.8)+
(number of cleavage site mismatches*1.2)+
(number of non-seed mismatches*1)

The most relevant off-target gene for each siRNA corresponding to the input 19mer sequence was defined as the gene with the lowest off-target score. The candidate oligomers were ranked first by the lowest off-target score for the antisense sequence, and secondarily by the lowest off-target score by its sense counterpart. The top 11 oligo sense and antisense pairs from the list were synthesized and their capacity for knockdown of the mouse GSK3α transcript measured. The sequences are shown in Table 4.

Sense and antisense oligomers complementary to the human GSK3α gene (NM_002093) were designed by first aligning the orthologous transcripts, and then identifying the human counterpart region of the mouse candidate target regions. The sequences are shown in Table 6.

siRNA Design for Mouse Glycogen Synthase Kinase 3 Beta (GSK3β)

All possible perfect match sense 19mer oligomers were extracted from NM_019827.4 the sole NCBI reference sequence for the mouse Gsk3β gene, and identified as candidate target regions. The sequences are shown in Table 2.

In order to rank candidate target sequences and their corresponding siRNAs and select appropriate ones, their predicted potential for interacting with irrelevant targets (off-target potential) was taken as the primary ranking parameter. siRNAs with low off-target potential were defined as preferable and assumed to be more specific in vivo.

To identify potential off-target genes, 19mer candidate sequences as well as their 19mer reverse complements were subjected to a homology search against the entire NCBI mouse reference mRNA sequence collection using the FASTA search algorithm (Pearson, W R, Lipman, D J. Improved Tools for Biological Sequence Comparison. PNAS (1988) 85: 2444-8).

The following off-target properties for every 19mer were extracted for each oligo-mouse transcript alignment to calculate the off-target score:
1. Number of mismatches in seed region, defined as positions 2-9 of the oligomer
2. Number of mismatches in cleavage site region, defined as positions 10 and 11
3. Number of mismatches in non-seed region, non-cleavage region, defined as positions 12-19
4. Mismatches in position 1 were ignored The off-target score for each oligo-transcript pair was calculated for considering assumptions 1 to 3 as follows:

Off-target score=(number of seed mismatches*2.8)+
(number of cleavage site mismatches*1.2)+
(number of non-seed mismatches*1)

The most relevant off-target gene for each siRNA corresponding to the input 19mer sequence was defined as the gene with the lowest off-target score. The candidate oligomers were ranked first by the lowest off-target score for the antisense sequence, and secondarily by the lowest off-target score by its sense counterpart. The top 11 oligo sense and antisense pairs from the list were synthesized and their capacity for knockdown of the mouse Gsk3β transcript measured. The sequences are shown in Table 5.

Sense and antisense oligomers complementary to the human GSK3β gene (NM_019884.2) were designed by first aligning the orthologous transcripts, and then identifying the human counterpart region of the mouse candidate target regions. The sequences are shown in Table 7.

Table 3 provides a description of the abbreviations used herein.

TABLE 3

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
|---|---|
| A | adenosine-5'-phosphate |
| C | cytidine-5'-phosphate |
| G | guanosine-5'-phosphate |
| T, dT | 2'-deoxy-thymidine-5'-phosphate |
| U | uridine-5'-phosphate |
| N | any nucleotide (G, A, C, or T) |
| a | 2'-O-methyladenosine-5'-phosphate |
| c | 2'-O-methylcytidine-5'-phosphate |
| g | 2'-O-methylguanosine-5'-phosphate |
| u | 2'-O-methyluridine-5'-phosphate |
| sT, sdT | 2'-deoxy-thymidine-5'phosphate-phosphorothioate |

GmbH, Darmstadt, Germany) and controlled pore glass

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs can be produced by solid phase synthesis on a scale of 1 mmole using an Expedite 8909 synthesizer (Applied Biosystems, Applera Deutschland (CPG, 500 Å, Proligo Biochemie GmbH, Hamburg, Germany) as solid support. RNA and RNA containing 2'-O-methyl nucleotides can be generated by solid phase synthesis employing the corresponding phosphoramidites and 2'-O-methyl phosphoramidites, respectively (Proligo Biochemie GmbH, Hamburg, Germany). These building blocks can be incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages can be introduced by replacement of the iodine oxidizer solution with a solution of the Beaucage reagent (Chruachem Ltd, Glasgow, UK) in acetonitrile (1%). Further ancillary reagents can be obtained from Mallinckrodt Baker (Griesheim, Germany).

Deprotection and purification of the crude oligoribonucleotides by anion exchange HPLC can be carried out according to established procedures. Yields and concentrations can be determined by UV absorption of a solution of the respective RNA at a wavelength of 260 nm using a spectral photometer (DU 640B, Beckman Coulter GmbH, Unterschleißheim, Germany). Double stranded RNA can be generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution can be stored at −20° C. until use.

For the synthesis of 3'-cholesterol-conjugated siRNAs (herein referred to as -Chol-3'), an appropriately modified solid support can be used for RNA synthesis. The modified solid support was prepared as follows:

Diethyl-2-azabutane-1,4-dicarboxylate AA

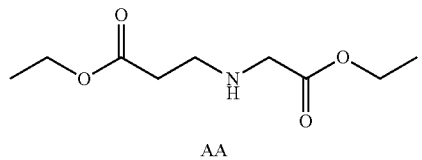

A 4.7 M aqueous solution of sodium hydroxide (50 mL) can be added into a stirred, ice-cooled solution of ethyl glycinate hydrochloride (32.19 g, 0.23 mole) in water (50 mL). Then, ethyl acrylate (23.1 g, 0.23 mole) can be added and the mixture can be stirred at room temperature until completion of the reaction can be ascertained by TLC. After 19 h the solution can be partitioned with dichloromethane (3×100 mL). The organic layer can be dried with anhydrous sodium sulfate, filtered and evaporated. The residue can be distilled to afford AA (28.8 g, 61%).

3-{Ethoxycarbonylmethyl-[6-(9H-fluoren-9-yl-methoxycarbonyl-amino)-hexanoyl]-amino}-propionic acid ethyl ester AB

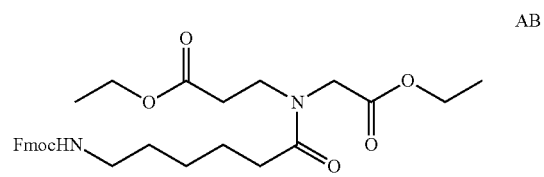

Fmoc-6-amino-hexanoic acid (9.12 g, 25.83 mmol) can be dissolved in dichloromethane (50 mL) and cooled with ice. Diisopropylcarbodiimde (3.25 g, 3.99 mL, 25.83 mmol) can be added to the solution at 0° C. It can then be followed by the addition of Diethyl-azabutane-1,4-dicarboxylate (5 g, 24.6 mmol) and dimethylamino pyridine (0.305 g, 2.5 mmol). The solution can be brought to room temperature and stirred further for 6 h. Completion of the reaction was ascertained by TLC. The reaction mixture can be concentrated under vacuum and ethyl acetate can be added to precipitate diisopropyl urea. The suspension can be filtered. The filtrate can be washed with 5% aqueous hydrochloric acid, 5% sodium bicarbonate and water. The combined organic layer can be dried over sodium sulfate and concentrated to give the crude product which can be purified by column chromatography (50% EtOAC/Hexanes) to yield 11.87 g (88%) of AB.

3-[(6-Amino-hexanoyl)-ethoxycarbonylmethyl-amino]-propionic acid ethyl ester AC

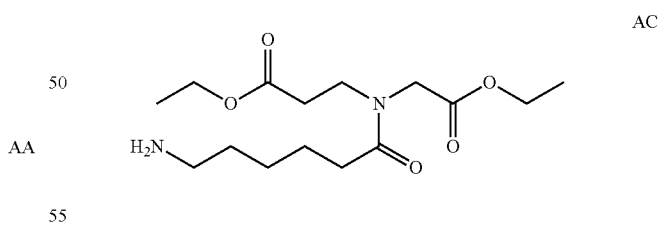

3-{Ethoxycarbonylmethyl-[6-(9H-fluoren-9-ylmethoxy-carbonylamino)-hexanoyl]-amino}-propionic acid ethyl ester AB (11.5 g, 21.3 mmol) can be dissolved in 20% piperidine in dimethylformamide at 0° C. The solution can be stirred continuously for 1 h. The reaction mixture can be concentrated under vacuum, water can be added to the residue, and the product can be extracted with ethyl acetate. The crude product can be purified by conversion into its hydrochloride salt.

3-({6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}ethoxycarbonylmethyl-amino)-propionic acid ethyl ester AD

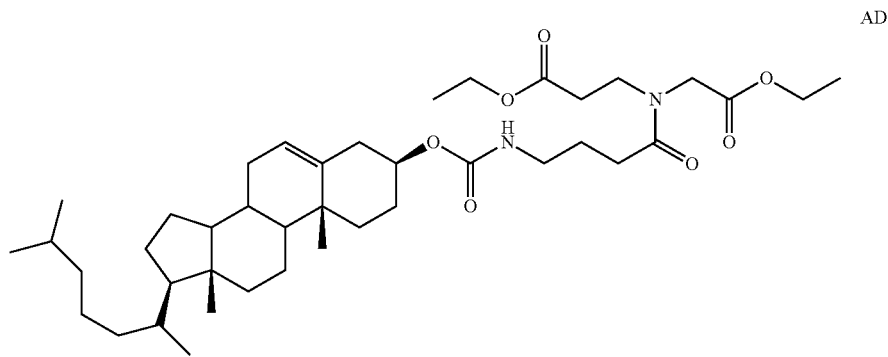 [SMILES: CCOC(=O)CCN(CC(=O)OCC)C(=O)CCCNC(=O)O[C@H]1CC[C@@]2(C)C(=CCC3C2CC[C@@]2(C)C3CC[C@@H]2C(C)CCCC(C)C)C1]

AD

The hydrochloride salt of 3-[(6-Amino-hexanoyl)-ethoxycarbonylmethyl-amino]-propionic acid ethyl ester AC (4.7 g, 14.8 mmol) can be taken up in dichloromethane. The suspension was cooled to 0° C. on ice. To the suspension diisopropylethylamine (3.87 g, 5.2 mL, 30 mmol) can be added. To the resulting solution cholesteryl chloroformate (6.675 g, 14.8 mmol) can be added. The reaction mixture can be stirred overnight. The reaction mixture can be diluted with dichloromethane and washed with 10% hydrochloric acid. The product can be purified by flash chromatography (10.3 g, 92%).

1-{6-[17-(1,5-Dimethyl-hexyl)-10,13-dimethyl-2,3,4,7,8,9,10,11,12,13,14,15,16,17-tetradecahydro-1H-cyclopenta[a]phenanthren-3-yloxycarbonylamino]-hexanoyl}-4-oxo-pyrrolidine-3-carboxylic acid ethyl ester AE Potassium t-butoxide (1.1 g, 9.8 mmol) can be slurried in 30 mL of dry toluene. The mixture can be cooled to 0° C. on ice and 5 g (6.6 mmol) of diester AD can be added slowly with stirring within 20 mins. The temperature can be kept below 5° C. during the addition. The stirring can be continued for 30 mins at 0° C. and 1 mL of glacial acetic acid can be added, immediately followed by 4 g of $NaH_2PO_4.H_2O$ in 40 mL of water. The resultant mixture can be extracted twice with 100 mL of dichloromethane each and the combined organic extracts can be washed twice with 10 mL of phosphate buffer each, dried, and evaporated to dryness. The residue can be dissolved in 60 mL of toluene, cooled to 0° C. and extracted with three 50 mL portions of cold pH 9.5 carbonate buffer. The aqueous extracts can be adjusted to pH 3 with phosphoric acid, and extracted with five 40 mL portions of chloroform which can be combined, dried and evaporated to dryness. The residue can be purified by column chromatography using 25% ethylacetate/hexane to afford 1.9 g of b-ketoester (39%).

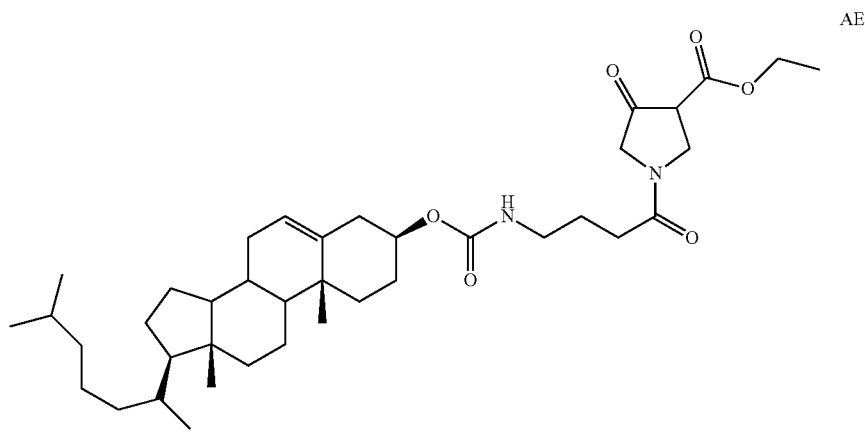 [SMILES: CCOC(=O)C1CN(C(=O)CCCNC(=O)O[C@H]2CC[C@@]3(C)C(=CCC4C3CC[C@@]3(C)C4CC[C@@H]3C(C)CCCC(C)C)C2)CC1=O]

AE

[6-(3-Hydroxy-4-hydroxymethyl-pyrrolidin-1-yl)-6-oxo-hexyl]-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AF

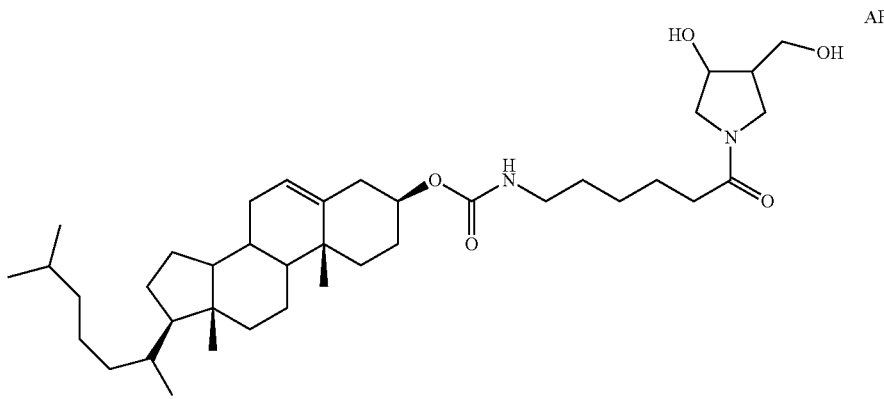 [SMILES: CC(C)CCCC(C)[C@H]1CCC2C3CC=C4C[C@@H](OC(=O)NCCCCCC(=O)N5CC(O)C(CO)C5)CC[C@]4(C)C3CC[C@@]21C]

Methanol (2 mL) can be added dropwise over a period of 1 h to a refluxing mixture of b-ketoester AE (1.5 g, 2.2 mmol) and sodium borohydride (0.226 g, 6 mmol) in tetrahydrofuran (10 mL). Stirring can be continued at reflux temperature for 1 h. After cooling to room temperature, 1 N HCl (12.5 mL) can be added, the mixture was extracted with ethylacetate (3×40 mL). The combined ethylacetate layer can be dried over anhydrous sodium sulfate and concentrated under vacuum to yield the product which can be purified by column chromatography (10% MeOH/CHCl$_3$) (89%).

(6-{3-[Bis-(4-methoxy-phenyl)-phenyl-methoxymethyl]-4-hydroxy-pyrrolidin-1-yl}-6-oxo-hexyl)-carbamic acid 17-(1,5-dimethyl-hexyl)-10,13-dimethyl-2,3,4,7,8,9,10,11,12,13,14,15,16,17-tetradecahydro-1H-cyclopenta[a]phenanthren-3-yl ester AG Diol AF (1.25 gm 1.994 mmol) can be dried by evaporating with pyridine (2×5 mL) in vacuo. Anhydrous pyridine (10 mL) and 4,4'-dimethoxytritylchloride (0.724 g, 2.13 mmol) can be added with stirring. The reaction can be carried out at room temperature overnight. The reaction can be quenched by the addition of methanol. The reaction mixture can be concentrated under vacuum and to the residue dichloromethane (50 mL) was added. The organic layer can be washed with 1M aqueous sodium bicarbonate. The organic layer can be dried over anhydrous sodium sulfate, filtered and concentrated. The residual pyridine can be removed by evaporating with toluene. The crude product can be purified by column chromatography (2% MeOH/Chloroform, Rf=0.5 in 5% MeOH/CHCl$_3$) (1.75 g, 95%).

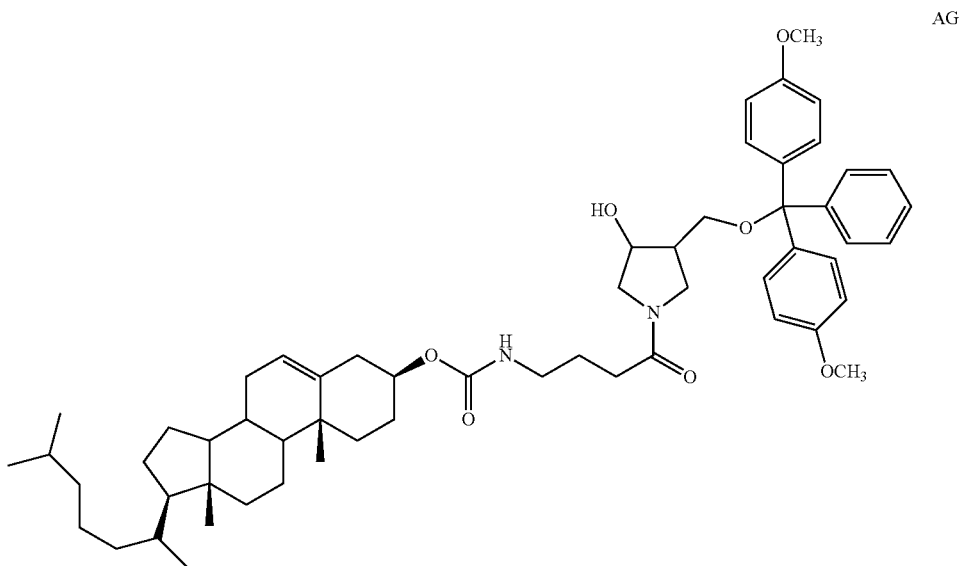 [SMILES: COc1ccc(C(OCC2CN(C(=O)CCCNC(=O)O[C@H]3CC[C@@]4(C)C(=CCC5C4CC[C@@]4(C)C5CC[C@@H]4C(C)CCCC(C)C)C3)CC2O)(c2ccccc2)c2ccc(OC)cc2)cc1]

Succinic acid mono-(4-[bis-(4-methoxy-phenyl)-phenyl-methoxymethyl]-1-{6-[17-(1,5-dimethyl-hexyl)-10,13-dimethyl 2,3,4,7,8,9,10,11,12,13,14,15,16,17-tetradecahydro-1H cyclopenta[a]phenanthren-3-yloxycarbonylamino]-hexanoyl}-pyrrolidin-3-yl) ester AH

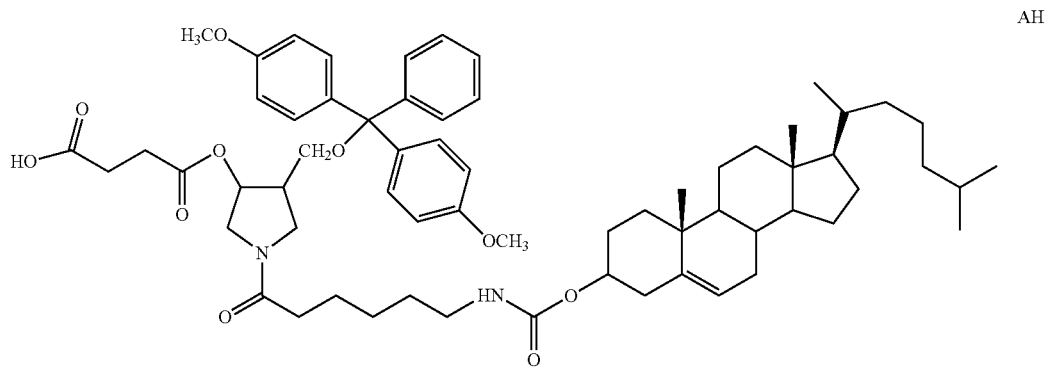

Compound AG (1.0 g, 1.05 mmol) can be mixed with succinic anhydride (0.150 g, 1.5 mmol) and DMAP (0.073 g, 0.6 mmol) and dried in a vacuum at 40° C. overnight. The mixture can be dissolved in anhydrous dichloroethane (3 mL), triethylamine (0.318 g, 0.440 mL, 3.15 mmol) can be added and the solution can be stirred at room temperature under argon atmosphere for 16 h. It can then be diluted with dichloromethane (40 mL) and washed with ice cold aqueous citric acid (5 wt %, 30 mL) and water (2×20 mL). The organic phase can be dried over anhydrous sodium sulfate and concentrated to dryness. The residue can be used as such for the next step.

Cholesterol Derivatised CPG AI

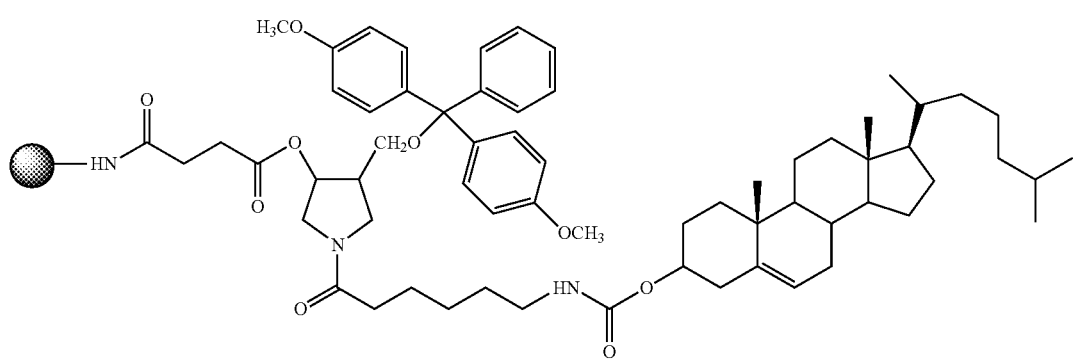

Succinate AH (0.254 g, 0.242 mmol) can be dissolved in a mixture of dichloromethane/acetonitrile (3:2, 3 mL). To that solution DMAP (0.0296 g, 0.242 mmol) in acetonitrile (1.25 mL), 2,2'-Dithio-bis(5-nitropyridine) (0.075 g, 0.242 mmol) in acetonitrile/dichloroethane (3:1, 1.25 mL) can be added successively. To the resulting solution triphenylphosphine (0.064 g, 0.242 mmol) in acetonitrile (0.6 ml) was added. The reaction mixture can turn bright orange in color. The solution can be agitated briefly using a wrist-action shaker (5 mins). Long chain alkyl amine-CPG (LCAA-CPG) (1.5 g, 61 mM) can be added. The suspension can be agitated for 2 h. The CPG was filtered through a sintered funnel and washed with acetonitrile, dichloromethane and ether successively. Unreacted amino groups can be masked using acetic anhydride/pyridine. The achieved loading of the CPG can be measured by taking UV measurement (37 mM/g).

The synthesis of siRNAs bearing a 5'-12-dodecanoic acid bisdecylamide group (herein referred to as "5'-C32-") or a 5'-cholesteryl derivative group (herein referred to as "5'-Chol-") can be performed as described in WO 2004/065601, except that, for the cholesteryl derivative, the oxidation step can be performed using the Beaucage reagent in order to introduce a phosphorothioate linkage at the 5'-end of the nucleic acid oligomer.

Example 2

In Vitro Screen of GSK3α and GSK3β siRNAs Against Endogenous GSK3α and GSK3β mRNA Expression in Mouse HT22 Cells Mouse HT22 cells were a gift from Dr. Marcy MacDonald and cultured in Dulbecco's modified Eagle's medium supplied with 10% fetal bovine serum and differentiated in modified serum-free medium (Dulbecco's modified Eagle's medium, N2 supplement, 50 ng/ml nerve growth factor-β, 100 μM phorbol 12,13-dibutyrate, 100 μM dibutyryl cAMP) for 24-48 h before treatment. All treatments were performed in differentiation medium with reduced nerve growth factor-β content (5 ng/ml) at 37° C. in a humidified incubator with 5% $CO_2$.

Cells were transfected with the modified siRNA targeting mouse GSK3α or GSK3β described in Table 4 and Table 5. For transfection with siRNA, HT22 cells were seeded at a density of $1.0 \times 10^5$ cells/well in 6-well tissue culture plates and transfected directly. Transfection of siRNA (37.5 nM for single dose screen) was carried out with Lipofectamine-2000 (Invitrogen, Carlsbad, Calif.) as described by the manufacturer. For dose-response curves, siRNA concentrations ranged from 10 nM to 0.1 nM in 10-fold dilutions.

24 hours after transfection, HT22 cells were lysed and cDNA was generated for GSK3α or GSK3β and GAPDH mRNA quantitation. GSK3α or GSK3β mRNA levels were normalized to GAPDH mRNA levels. For each siRNA, 2 individual data points were collected. An siRNA duplex unrelated to the GSK3α or GSK3β gene was used as a control. The activity of a given GSK3α- or GSK3β-specific siRNA duplex was expressed as the fraction of the GSK3α or GSK3β mRNA level in treated cells relative to the GSK3α or GSK3β mRNA level in cells treated with the control siRNA duplex.

Duplex identifier used in the Figures and in Examples 2-5 refer to the modified version of the duplex, e.g., AD-18821 as used in the Figures and Examples 2-5 refers to the modified version of AD-18821, e.g., AD-18821-b1.

Figure 2:
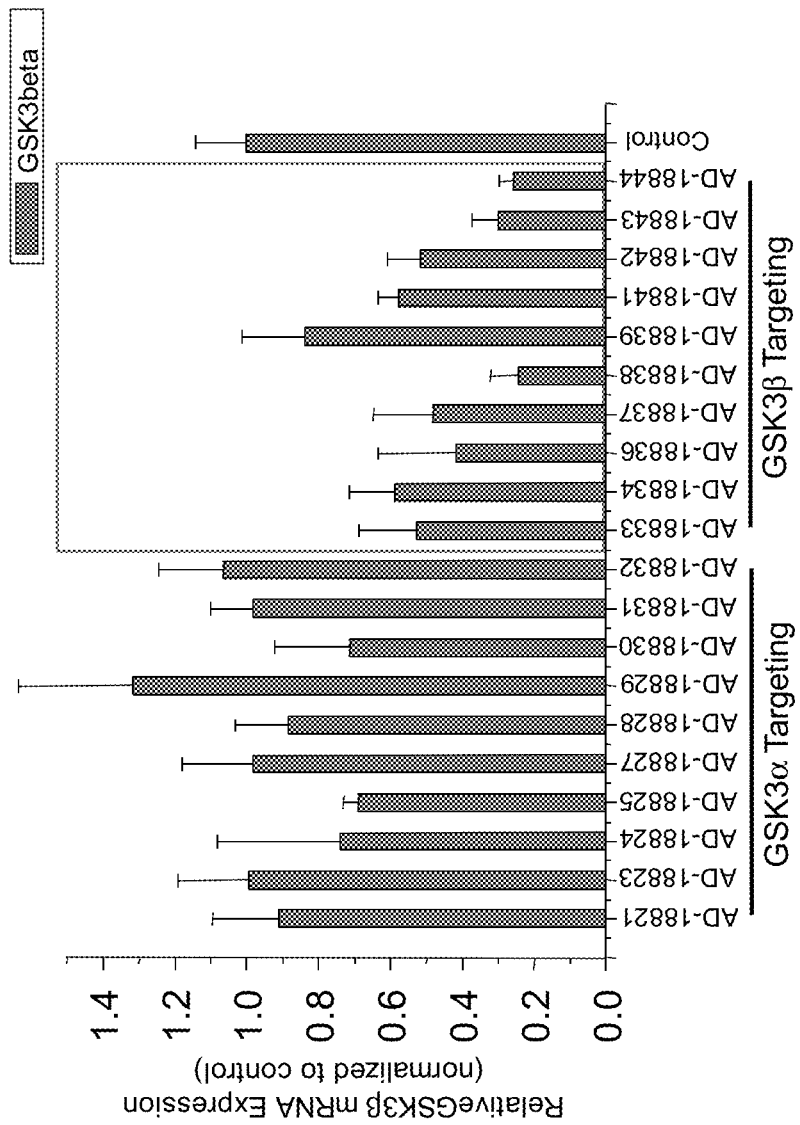
FIG. 2 is a graph illustrating the results of GSK3β mRNA suppression in HT22 cells 24 hours after 37.5 nM siRNA transfection.

FIG. 1 and FIG. 2 provide the results from the in vitro HT22 screen where the siRNAs were tested at a single dose of 37.5 nM. The fraction of GSK3α and GSK3β mRNA remaining in treated cells compared to controls, ±standard deviation, is shown. A number of GSK3α siRNAs (AD-18821, AD-18825 or AD-18832) at 37.5 nM were effective at reducing GSK3α mRNA levels by more than 40%, without affecting GSK3β mRNA levels, in HT22 cells. A number of GSK3β siRNAs (AD-18833, AD-18834, AD-18836, AD-18837, AD-18838, AD-18841, AD-18842, AD-18843 or AD-18844) at 37.5 nM were effective at reducing GSK3 β mRNA levels by more than 40%, without affecting GSK3α mRNA levels, in HT22 cells.

Figure 3:
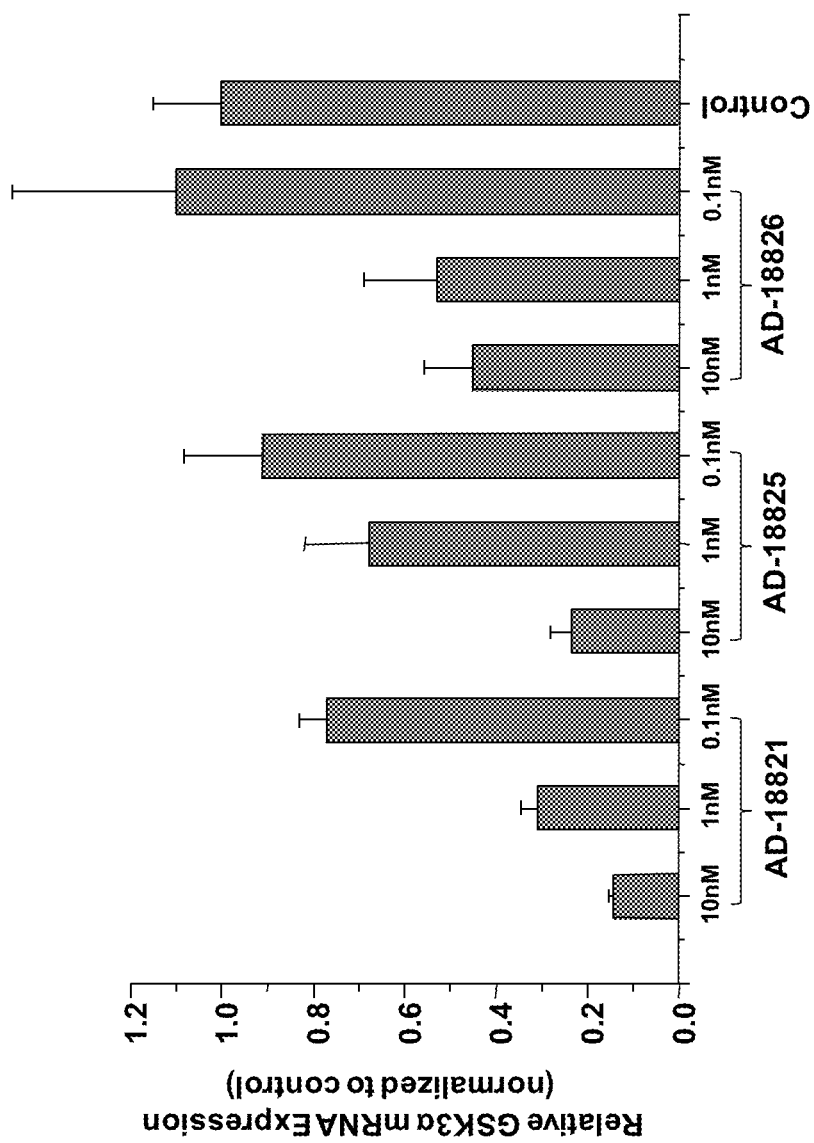
FIG. 3 is a graph illustrating the dose dependence of GSK3α mRNA suppression after siRNA transfection of HT22 cells.
Figure 4:
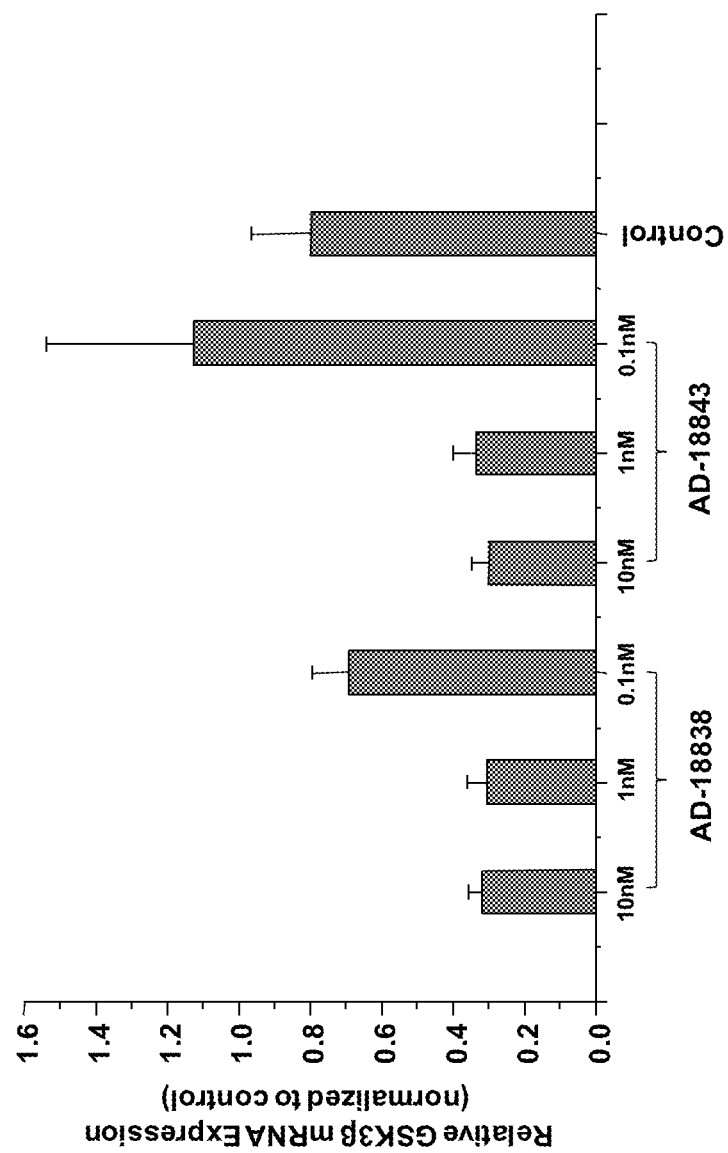
FIG. 4 is a graph illustrating the dose dependence of GSK3 β mRNA suppression after siRNA transfection of HT22 cells.

FIG. 3 and FIG. 4 show the dose-dependence of selected siRNAs on mRNA reduction in HT22 cells. Several siRNAs targeting GSK3α (AD-18821, AD-18825 or AD-18826) exhibited IC50 values of less than or equal to 1-10 nM in suppressing GSK3α mRNA after transfection into HT22 cells (FIG. 3). Several siRNAs targeting GSK3β (AD-18838 or AD-18843) exhibited IC50 values of less than 1 nM in suppressing GSK3β mRNA (FIG. 4).

Example 3

GSK3β dsRNAs Reduce Endogenous GSK3β Protein in HT22 Cells

HT22 cells were cultured and transfected as previously described with 75 nM of 11 siRNAs against GSK3β (AD-18833, AD-18834, AD-18835, AD-18836, AD-18837, AD-18838, AD-18839, AD-18841, AD-18842, AD-18843 or AD-18844); one control unrelated siRNA (AD-1955) or Lipofectamine-2000 alone (Control). 48 hours post-transfection, the cells were harvested and lysed. Proteins in the lysates were separated on a denaturing polyacrylamide gel. GSK3β and β-actin were detected by standard western blot protocols using antibodies that bind to the proteins. For GSK3β detection, the membrane was probed with a monoclonal GSK3β antibody produced in rabbit (Cell Signaling, Danvers, Mass.) followed by a secondary antibody donkey anti-rabbit IgG horseradish peroxidase (GE Healthcare, Piscataway, N.J.). β-actin was detected by mouse anti-actin antibody (Sigma, St. Louis, Mo.) followed by a Sheep anti-mouse IgG horseradish peroxidase secondary antibody (GE Healthcare, Piscataway, N.J.).

Figure 5:
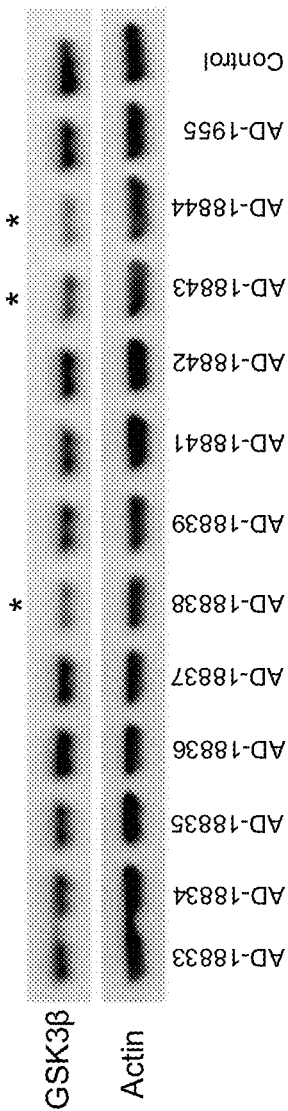
FIG. 5 is a western blot illustrating protein levels after siRNA transfection in HT22 cells.

FIG. 5 provides the results. AD-18838, AD-18843 and AD-18844, all at 75 nM, decreased the level of GSK3β protein relative to the control protein β-actin, whereas the control unrelated siRNA had no effect on the level of GSK3β protein. These results demonstrate that dsRNAs targeting GSK3β effectively reduce not only GSK3β mRNA levels, but also GSK3β protein levels.

Example 4

In Vivo Down-Modulation of Endogenous GSK3α or GSK3β mRNA Levels by CNS Administration of GSK3α or GSK3β dsRNAs in Mice To assess the biological activity of GSK3 dsRNAs in vivo, dsRNAs targeting GSK3α (AD-18821, AD-18825, and AD-18826) or GSK3β (AD-18838, AD-18843, and AD-18844) were evaluated.

In mice, 1.26 mg AD-18821, AD-18825, AD-18826, AD-18838, AD-18843, AD-18844, or phosphate-buffered saline (PBS, vehicle control) was administered by continuous infusion into the nucleus accumbens over 14 days. Ten week old male C57BL6 mice (Charles River Laboratory) received stereotaxic implantations of 30-gauge infusion cannulae (Plastics One, Roanok, Va.) such that unilateral infusions were targeted to the nucleus accumbens (anteroposterior+1.1 mm, mediolateral+1.3 mm, relative to bregma; dorsoventral 4.5 mm, relative to skull surface). Mini-osmotic pumps (model 1002) were primed overnight according to the manufacturer's specifications, implanted subcutaneously, and connected via catheters, to deliver (6 mice per treatment group) PBS, 1.1 mM (15 mg/mL) of GSK3α siRNAs (AD-18821, AD-18825, or AD-18826) or 1.1 mM (15 mg/mL) of GSK3β siRNAs (AD-18838, AD-18843, or AD-18844) at 0.25 μL/hr over 14 days. At the end of the 14 day infusion period, animals were sacrificed, brains were removed, and 1.2 mm punches from the ipsilateral nucleus accumbens encompassing the infusion site, from 1 mm thick coronal brain slabs, were flash frozen and stored at −80° C. Individual brain punches from each mouse were quantified for GSK3α and GSK3β mRNA. Each brain punch was run in triplicate for RT-qPCR. Approximately 60 ng of total RNA in a 20 μl total reaction volume was used for RT-qPCR. GSK3α and GSK3β primers were custom designed and obtained from IDT (Integrated DNA Technologies, Inc., Coralville, Iowa). RT-qPCR was run with SBYR. GAPDH was used as the internal control for normalization. Relative expression of GSK3α and GSK3β mRNA was quantified by $2^{\Delta Ct}$ (where $\Delta Ct = Ct_{gene} - Ct_{GAPDH}$).

Figure 6:
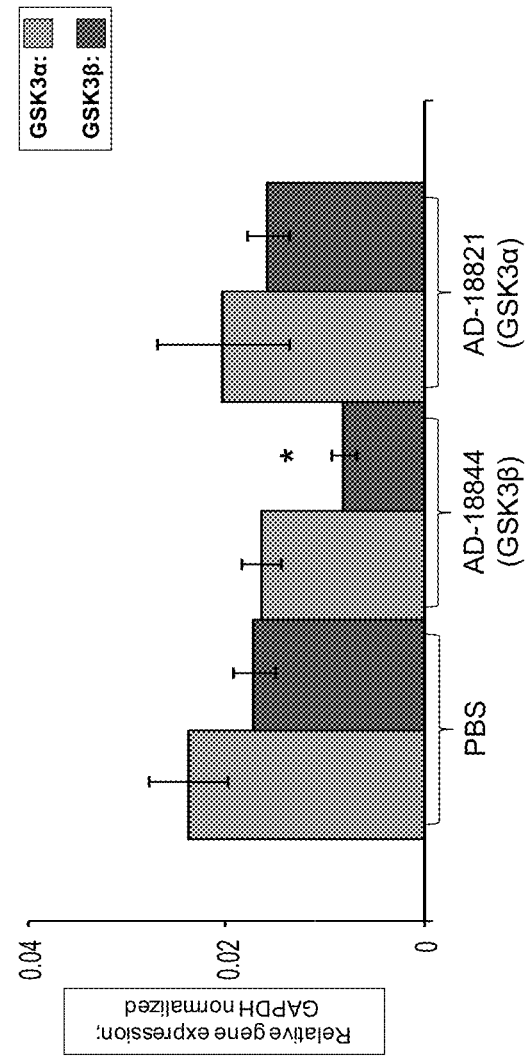
FIG. 6 is a graph illustrating GSK3β mRNA suppression in mouse nucleus accumbens after 14 day infusion of AD-18844 into the nucleus accumbens.
Figure 7:
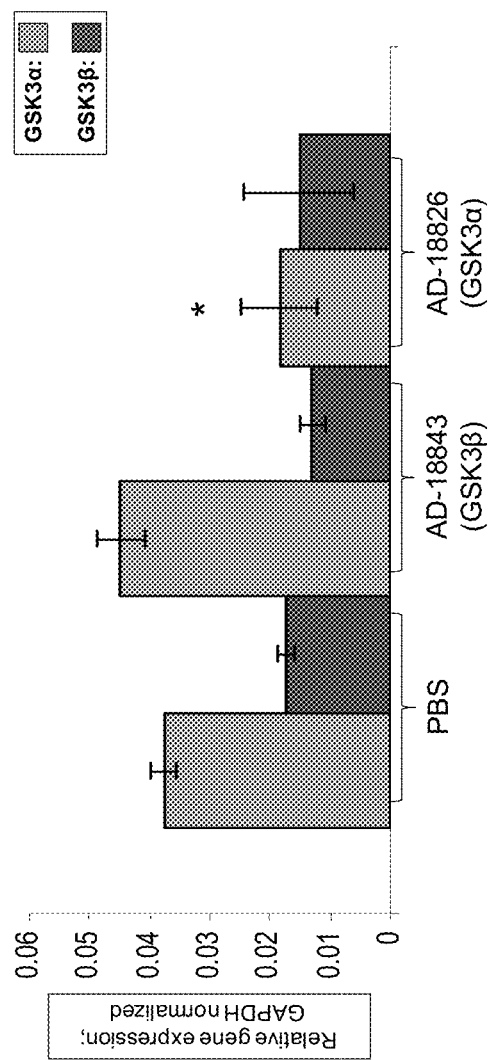
FIG. 7 is a graph illustrating GSK3α mRNA suppression in mouse nucleus accumbens after 14 day infusion of AD-18826 into the nucleus accumbens.

The GSK3β siRNAs, AD-18844, AD-18838 or AD-18843, showed 53% (ANOVA; p=0.012) (FIG. 6), 28% or 25% GSK3β mRNA reduction in the ipsilateral nucleus accumbens, respectively, compared to PBS control. The GSK3β siRNA, AD-18844, had no effect on GSK3α mRNA levels. The GSK3α siRNAs, AD-18826, AD-18825 or AD-18821, showed 51% (p=0.052; Tukey Post-hoc ANOVA) (FIG. 7), 42% (t-test; p=0.004) or 15% GSK3α mRNA reduction in the ipsilateral nucleus accumbens, respectively, compared to PBS control. The GSK3α siRNA, AD-18826, had no effect on GSK3β mRNA levels.

These results demonstrate that infusion into the nucleus accumbens of AD-18844 and AD-18826 are efficacious in vivo in specifically down-modulating GSK3β and GSK3α mRNA levels, respectively, in the nucleus accumbens.

Example 5

Inhibition of GSK-3 Expression in Human Cells

A set of siRNA targeting human GSK3α and GSK3β (Table 6 and Table 7) are evaluated for inhibition of GSK-3 expression in human cell lines. Human cell lines expressing endogenouseGSK3 are transfected with at least one of the duplexes in Table 6 or Table 7, e.g., huGSKA-3 (orthologous to AD-18826-b1) and/or huGSKB-11 (orthologous to AD-18826-b1). The human duplexes can be modified in a similar manner to the mouse duplexes. The transfected cells are assayed for effects on mRNA and protein levels using techniques described herein and known to one of skill in the art.

Example 6

Inhibition of GSK-3 Expression in Humans

A human subject is treated with a pharmaceutical composition comprising a pharmaceutical formulation of an siRNA targeting a human GSK-3 gene.

A subject in need of treatment is selected or identified. The subject can be in need of treatment for manic depression, a metabolic disease, a nervous system disorders, or cancer.

At time zero, a suitable first dose of the composition is subcutaneously administered to the subject. The composition is formulated as described herein. After a period of time, the subject's condition is evaluated, e.g., by measurement episodes of mania, episodes of depression, and the like. This measurement can be accompanied by a measurement of GSK-3 expression in said subject, and/or the products of the successful siRNA-targeting of GSK-3. Other relevant criteria can also be measured. The number and strength of doses are adjusted according to the subject's needs.

After treatment, the subject's condition is compared to the condition existing prior to the treatment, or relative to the condition of a similarly afflicted but untreated subject.

TABLE 1

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 670-689 | 1 | AACUGCAGAUUAUGCGUAA | 2 | AAcuGcAGAuuAuGcGuAAdTsdT | sense |
| 670-689 | 3 | UUACGCAUAAUCUGCAGUU | 4 | UuACGcAuAAUCUGcAGUUdTsdT | antis |
| 1074-1093 | 5 | ACAGAUUACACCUCGUCCA | 6 | AcAGAuuAcAccucGuccAdTsdT | sense |
| 1074-1093 | 7 | UGGACGAGGUGUAAUCUGU | 8 | UGGACGAGGUGuAAUCUGUdTsdT | antis |
| 330-349 | 9 | GGCGGCGGGAAAGCGUCAG | 10 | GGcGGcGGGAAAGcGucAGdTsdT | sense |
| 330-349 | 11 | CUGACGCUUUCCCGCCGCC | 12 | CUGACGCUUUCCCGCCGCCdTsdT | antis |
| 239-258 | 13 | GGCGCGGACCAGCUCGUUC | 14 | GGcGcGGAccAGcucGuucdTsdT | sense |
| 239-258 | 15 | GAACGAGCUGGUCCGCGCC | 16 | GAACGAGCUGGUCCGCGCCdTsdT | antis |
| 1340-1359 | 17 | CCUACUGGAGUACACGCCA | 18 | ccuAcuGGAGuAcAcGccAdTsdT | sense |
| 1340-1359 | 19 | UGGCGUGUACUCCAGUAGG | 20 | UGGCGUGuACUCcAGuAGGdTsdT | antis |
| 1342-1361 | 21 | UACUGGAGUACACGCCAUC | 22 | uAcuGGAGuAcAcGccAucdTsdT | sense |
| 1342-1361 | 23 | GAUGGCGUGUACUCCAGUA | 24 | GAUGGCGUGuACUCcAGuAdTsdT | antis |
| 1073-1092 | 25 | CACAGAUUACACCUCGUCC | 26 | cAcAGAuuAcAccucGuccdTsdT | sense |
| 1073-1092 | 27 | GGACGAGGUGUAAUCUGUG | 28 | GGACGAGGUGuAAUCUGUGdTsdT | antis |
| 1236-1255 | 29 | CCUAACUAUACGGAGUUCA | 30 | ccuAAcuAuAcGGAGuucAdTsdT | sense |
| 1236-1255 | 31 | UGAACUCCGUAUAGUUAGG | 32 | UGAACUCCGuAuAGUuAGGdTsdT | antis |
| 435-454 | 33 | GCGGGCACUAGCUUCCCGC | 34 | GcGGGcAcuAGcuucccGcdTsdT | sense |
| 435-454 | 35 | GCGGGAAGCUAGUGCCCGC | 36 | GCGGGAAGCuAGUGCCCGCdTsdT | antis |
| 1231-1250 | 37 | UGAACCCUAACUAUACGGA | 38 | uGAAcccuAAcuAuAcGGAdTsdT | sense |
| 1231-1250 | 39 | UCCGUAUAGUUAGGGUUCA | 40 | UCCGuAuAGUuAGGGUUcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1234-1253 | 41 | ACCCUAACUAUACGGAGUU | 42 | AcccuAAcuAuAcGGAGuudTsdT | sense |
| 1234-1253 | 43 | AACUCCGUAUAGUUAGGGU | 44 | AACUCCGuAuAGUuAGGGUdTsdT | antis |
| 1235-1254 | 45 | CCCUAACUAUACGGAGUUC | 46 | cccuAAcuAuAcGGAGuucdTsdT | sense |
| 1235-1254 | 47 | GAACUCCGUAUAGUUAGGG | 48 | GAACUCCGuAuAGUuAGGGdTsdT | antis |
| 1233-1252 | 49 | AACCCUAACUAUACGGAGU | 50 | AAcccuAAcuAuAcGGAGudTsdT | sense |
| 1233-1252 | 51 | ACUCCGUAUAGUUAGGGUU | 52 | ACUCCGuAuAGUuAGGGUUdTsdT | antis |
| 2027-2046 | 53 | GCCCCCUGGGUGUAAAUAG | 54 | GccccuGGGuGuAAAuAGdTsdT | sense |
| 2027-2046 | 55 | CUAUUUACACCCAGGGGGC | 56 | CuAUUuAcACCcAGGGGGCdTsdT | antis |
| 5-24 | 57 | UGACAACGAAGCCGACGGC | 58 | uGAcAAcGAAGccGAcGGCdTsdT | sense |
| 5-24 | 59 | GCCGUCGGCUUCGUUGUCA | 60 | GCCGUCGGCUUCGUUGUcAdTsdT | antis |
| 1071-1090 | 61 | GCCACAGAUUACACCUCGU | 62 | GccAcAGAuuAcAccucGudTsdT | sense |
| 1071-1090 | 63 | ACGAGGUGUAAUCUGUGGC | 64 | ACGAGGUGuAAUCUGUGGCdTsdT | antis |
| 2000-2019 | 65 | AGCCCAUCUCUCGUCUUCC | 66 | AGcccAucucucGucuuccdTsdT | sense |
| 2000-2019 | 67 | GGAAGACGAGAGAUGGGCU | 68 | GGAAGACGAGAGAUGGGCUdTsdT | antis |
| 4-23 | 69 | GUGACAACGAAGCCGACGG | 70 | GuGAcAAcGAAGccGAcGGdTsdT | sense |
| 4-23 | 71 | CCGUCGGCUUCGUUGUCAC | 72 | CCGUCGGCUUCGUUGUcACdTsdT | antis |
| 1085-1104 | 73 | CUCGUCCAUCGAUGUGUGG | 74 | cucGuccAucGAuGuGuGGdTsdT | sense |
| 1085-1104 | 75 | CCACACAUCGAUGGACGAG | 76 | CcAcAcAUCGAUGGACGAGdTsdT | antis |
| 2070-2089 | 77 | AAACGUCAAUUCACACCAU | 78 | AAAcGucAAuucAcAccAudTsdT | sense |
| 2070-2089 | 79 | AUGGUGUGAAUUGACGUUU | 80 | AUGGUGUGAAUUGACGUUUdTsdT | antis |
| 2072-2091 | 81 | ACGUCAAUUCACACCAUUC | 82 | AcGucAAuucAcAccAuucdTsdT | sense |
| 2072-2091 | 83 | GAAUGGUGUGAAUUGACGU | 84 | GAAUGGUGUGAAUUGACGUdTsdT | antis |
| 251-270 | 85 | CUCGUUCGCGGAGCCAGGA | 86 | cucGuucGcGGAGccAGGAdTsdT | sense |
| 251-270 | 87 | UCCUGGCUCCGCGAACGAG | 88 | UCCUGGCUCCGCGAACGAGdTsdT | antis |
| 241-260 | 89 | CGCGGACCAGCUCGUUCGC | 90 | cGcGGAccAGcucGuucGcdTsdT | sense |
| 241-260 | 91 | GCGAACGAGCUGGUCCGCG | 92 | GCGAACGAGCUGGUCCGCGdTsdT | antis |
| 581-600 | 93 | CGGAGUAGUAUACCAGGCA | 94 | cGGAGuAGuAuAccAGGcAdTsdT | sense |
| 581-600 | 95 | UGCCUGGUAUACUACUCCG | 96 | UGCCUGGuAuAcUACUCCGdTsdT | antis |
| 1076-1095 | 97 | AGAUUACACCUCGUCCAUC | 98 | AGAuuAcAccucGuccAucdTsdT | sense |
| 1076-1095 | 99 | GAUGGACGAGGUGUAAUCU | 100 | GAUGGACGAGGUGuAAUCUdTsdT | antis |
| 2069-2088 | 101 | AAAACGUCAAUUCACACCA | 102 | AAAAcGucAAuucAcAccAdTsdT | sense |
| 2069-2088 | 103 | UGGUGUGAAUUGACGUUUU | 104 | UGGUGUGAAUUGACGUUUUdTsdT | antis |
| 6-25 | 105 | GACAACGAAGCCGACGGCA | 106 | GAcAAcGAAGccGAcGGcAdTsdT | sense |
| 6-25 | 107 | UGCCGUCGGCUUCGUUGUC | 108 | UGCCGUCGGCUUCGUUGUCdTsdT | antis |
| 16-35 | 109 | CCGACGGCAGAGGGACUUC | 110 | ccGAcGGcAGAGGGAcuucdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 16-35 | 111 | GAAGUCCCUCUGCCGUCGG | 112 | GAAGUCCCUCUGCCGUCGGdTsdT | antis |
| 243-262 | 113 | CGGACCAGCUCGUUCGCGG | 114 | cGGAccAGcucGuucGcGGdTsdT | sense |
| 243-262 | 115 | CCGCGAACGAGCUGGUCCG | 116 | CCGCGAACGAGCUGGUCCGdTsdT | antis |
| 244-263 | 117 | GGACCAGCUCGUUCGCGGA | 118 | GGAccAGcucGuucGcGGAdTsdT | sense |
| 244-263 | 119 | UCCGCGAACGAGCUGGUCC | 120 | UCCGCGAACGAGCUGGUCCdTsdT | antis |
| 328-347 | 121 | CUGGCGGCGGGAAAGCGUC | 122 | cuGGcGGcGGGAAAGcGucdTsdT | sense |
| 328-347 | 123 | GACGCUUUCCCGCCGCCAG | 124 | GACGCUUUCCCGCCGCcAGdTsdT | antis |
| 331-350 | 125 | GCGGCGGGAAAGCGUCAGU | 126 | GcGGcGGGAAAGcGucAGudTsdT | sense |
| 331-350 | 127 | ACUGACGCUUUCCCGCCGC | 128 | ACUGACGCUUUCCCGCCGCdTsdT | antis |
| 340-359 | 129 | AAGCGUCAGUCGGGGCUAU | 130 | AAGcGucAGucGGGGcuAudTsdT | sense |
| 340-359 | 131 | AUAGCCCCGACUGACGCUU | 132 | AuAGCCCCGACUGACGCUUdTsdT | antis |
| 432-451 | 133 | GGCGCGGGCACUAGCUUCC | 134 | GGcGcGGGcAcuAGcuuccdTsdT | sense |
| 432-451 | 135 | GGAAGCUAGUGCCCGCGCC | 136 | GGAAGCuAGUGCCCGCGCCdTsdT | antis |
| 655-674 | 137 | GGUUCAAGAACCGAGAACU | 138 | GGuucAAGAAccGAGAAcudTsdT | sense |
| 655-674 | 139 | AGUUCUCGGUUCUUGAACC | 140 | AGUUCUCGGUUCUUGAACCdTsdT | antis |
| 1024-1043 | 141 | CCUACAUCUGCUCUCGGUA | 142 | ccuAcAucuGcucucGGuAdTsdT | sense |
| 1024-1043 | 143 | UACCGAGAGCAGAUGUAGG | 144 | uACCGAGAGcAGAUGuAGGdTsdT | antis |
| 1075-1094 | 145 | CAGAUUACACCUCGUCCAU | 146 | cAGAuuAcAccucGuccAudTsdT | sense |
| 1075-1094 | 147 | AUGGACGAGGUGUAAUCUG | 148 | AUGGACGAGGUGuAAUCUGdTsdT | antis |
| 1089-1108 | 149 | UCCAUCGAUGUGUGGUCGG | 150 | uccAucGAuGuGuGGucGGdTsdT | sense |
| 1089-1108 | 151 | CCGACCACACAUCGAUGGA | 152 | CCGACcAcAcAUCGAUGGAdTsdT | antis |
| 1090-1109 | 153 | CCAUCGAUGUGUGGUCGGC | 154 | ccAucGAuGuGuGGucGGcdTsdT | sense |
| 1090-1109 | 155 | GCCGACCACACAUCGAUGG | 156 | GCCGACcAcAcAUCGAUGGdTsdT | antis |
| 1092-1111 | 157 | AUCGAUGUGUGGUCGGCUG | 158 | AucGAuGuGuGGucGGcuGdTsdT | sense |
| 1092-1111 | 159 | CAGCCGACCACACAUCGAU | 160 | cAGCCGACcAcAcAUCGAUdTsdT | antis |
| 1093-1112 | 161 | UCGAUGUGUGGUCGGCUGG | 162 | ucGAuGuGuGGucGGcuGGdTsdT | sense |
| 1093-1112 | 163 | CCAGCCGACCACACAUCGA | 164 | CcAGCCGACcAcAcAUCGAdTsdT | antis |
| 1230-1249 | 165 | AUGAACCCUAACUAUACGG | 166 | AuGAAcccuAAcuAuAcGGdTsdT | sense |
| 1230-1249 | 167 | CCGUAUAGUUAGGGUUCAU | 168 | CCGuAuAGUuAGGGUUcAUdTsdT | antis |
| 1348-1367 | 169 | AGUACACGCCAUCCUCAAG | 170 | AGuAcAcGccAuccucAAGdTsdT | sense |
| 1348-1367 | 171 | CUUGAGGAUGGCGUGUACU | 172 | CUUGAGGAUGGCGUGuACUdTsdT | antis |
| 1401-1420 | 173 | UUCGAUGAACUGCGGAGAC | 174 | uucGAuGAAcuGcGGAGAcdTsdT | sense |
| 1401-1420 | 175 | GUCUCCGCAGUUCAUCGAA | 176 | GUCUCCGcAGUUcAUCGAAdTsdT | antis |
| 1402-1421 | 177 | UCGAUGAACUGCGGAGACU | 178 | ucGAuGAAcuGcGGAGAcudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1402-1421 | 179 | AGUCUCCGCAGUUCAUCGA | 180 | AGUCUCCGcAGUUcAUCGAdTsdT | antis |
| 1489-1508 | 181 | UCCAACCAUCUCUCAAUGC | 182 | uccAAccAucucucAAuGcdTsdT | sense |
| 1489-1508 | 183 | GCAUUGAGAGAUGGUUGGA | 184 | GcAUUGAGAGAUGGUUGGAdTsdT | antis |
| 1999-2018 | 185 | CAGCCCAUCUCUCGUCUUC | 186 | cAGcccAucucucGucuucdTsdT | sense |
| 1999-2018 | 187 | GAAGACGAGAGAUGGGCUG | 188 | GAAGACGAGAGAUGGGCUGdTsdT | antis |
| 2028-2047 | 189 | CCCCCUGGGUGUAAAUAGA | 190 | cccccuGGGuGuAAAuAGAdTsdT | sense |
| 2028-2047 | 191 | UCUAUUUACACCCAGGGGG | 192 | UCuAUUuAcACCcAGGGGGdTsdT | antis |
| 2068-2087 | 193 | GAAAACGUCAAUUCACACC | 194 | GAAAAcGucAAuucAcAccdTsdT | sense |
| 2068-2087 | 195 | GGUGUGAAUUGACGUUUUC | 196 | GGUGUGAAUUGACGUUUUCdTsdT | antis |
| 2080-2099 | 197 | UCACACCAUUCAACUUGCC | 198 | ucAcAccAuucAAcuuGccdTsdT | sense |
| 2080-2099 | 199 | GGCAAGUUGAAUGGUGUGA | 200 | GGcAAGUUGAAUGGUGUGAdTsdT | antis |
| 2083-2102 | 201 | CACCAUUCAACUUGCCCCC | 202 | cAccAuucAAcuuGcccccdTsdT | sense |
| 2083-2102 | 203 | GGGGGCAAGUUGAAUGGUG | 204 | GGGGGcAAGUUGAAUGGUGdTsdT | antis |
| 2084-2103 | 205 | ACCAUUCAACUUGCCCCCC | 206 | AccAuucAAcuuGccccccdTsdT | sense |
| 2084-2103 | 207 | GGGGGGCAAGUUGAAUGGU | 208 | GGGGGGcAAGUUGAAUGGUdTsdT | antis |
| 2086-2105 | 209 | CAUUCAACUUGCCCCCCCC | 210 | cAuucAAcuuGccccccccdTsdT | sense |
| 2086-2105 | 211 | GGGGGGGGCAAGUUGAAUG | 212 | GGGGGGGGcAAGUUGAAUGdTsdT | antis |
| 2244-2263 | 213 | UUGGCAUGAAACCCUUAAA | 214 | uuGGcAuGAAAcccuuAAAdTsdT | sense |
| 2244-2263 | 215 | UUUAAGGGUUUCAUGCCAA | 216 | UUuAAGGGUUUcAUGCcAAdTsdT | antis |
| 71-90 | 217 | AGCCGGAGCCCGAACGGCG | 218 | AGccGGAGcccGAAcGGcGdTsdT | sense |
| 71-90 | 219 | CGCCGUUCGGGCUCCGGCU | 220 | CGCCGUUCGGGCUCCGGCUdTsdT | antis |
| 177-196 | 221 | CCUGCGCUCGGCGCCAUGA | 222 | ccuGcGcucGGcGccAuGAdTsdT | sense |
| 177-196 | 223 | UCAUGGCGCCGAGCGCAGG | 224 | UcAUGGCGCCGAGCGcAGGdTsdT | antis |
| 836-855 | 225 | CACCCCUAUCAUCUACAUC | 226 | cAccccuAucAucuAcAucdTsdT | sense |
| 836-855 | 227 | GAUGUAGAUGAUAGGGGUG | 228 | GAUGuAGAUGAuAGGGGUGdTsdT | antis |
| 929-948 | 229 | GCCCCAGAAUUUGCUUGUG | 230 | GccccAGAAuuuGcuuGuGdTsdT | sense |
| 929-948 | 231 | CACAAGCAAAUUCUGGGGC | 232 | cAcAAGcAAAUUCUGGGGCdTsdT | antis |
| 1001-1020 | 233 | GGUUCGGGGGAGCCCAAU | 234 | GGuucGGGGGAGcccAAudTsdT | sense |
| 1001-1020 | 235 | AUUGGGCUCCCCCCGAACC | 236 | AUUGGGCUCCCCCCGAACCdTsdT | antis |
| 1091-1110 | 237 | CAUCGAUGUGUGGUCGGCU | 238 | cAucGAuGuGuGGucGGcudTsdT | sense |
| 1091-1110 | 239 | AGCCGACCACACAUCGAUG | 240 | AGCCGACcAcAcAUCGAUGdTsdT | antis |
| 1328-1347 | 241 | ACUCUGCUCUAGCCUACUG | 242 | AcucuGcucuAGccuAcuGdTsdT | sense |
| 1328-1347 | 243 | CAGUAGGCUAGAGCAGAGU | 244 | cAGuAGGCuAGAGcAGAGUdTsdT | antis |
| 1338-1357 | 245 | AGCCUACUGGAGUACACGC | 246 | AGccuAcuGGAGuAcAcGcdTsdT | sense |
| 1338-1357 | 247 | GCGUGUACUCCAGUAGGCU | 248 | GCGUGuACUCcAGuAGGCUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1339-1358 | 249 | GCCUACUGGAGUACACGCC | 250 | GccuAcuGGAGuAcAcGccdTsdT | sense |
| 1339-1358 | 251 | GGCGUGUACUCCAGUAGGC | 252 | GGCGUGuACUCcAGuAGGCdTsdT | antis |
| 2059-2078 | 253 | UUUCUUAAAGAAAACGUCA | 254 | uuucuuAAAGAAAAcGucAdTsdT | sense |
| 2059-2078 | 255 | UGACGUUUUCUUUAAGAAA | 256 | UGACGUUUUCUUuAAGAAAdTsdT | antis |
| 2067-2086 | 257 | AGAAAACGUCAAUUCACAC | 258 | AGAAAcGucAAuucAcAcdTsdT | sense |
| 2067-2086 | 259 | GUGUGAAUUGACGUUUUCU | 260 | GUGUGAAUUGACGUUUUCUdTsdT | antis |
| 2076-2095 | 261 | CAAUUCACACCAUUCAACU | 262 | cAAuucAcAccAuucAAcudTsdT | sense |
| 2076-2095 | 263 | AGUUGAAUGGUGUGAAUUG | 264 | AGUUGAAUGGUGUGAAUUGdTsdT | antis |
| 2089-2108 | 265 | UCAACUUGCCCCCCCAGC | 266 | ucAAcuuGccccccccAGcdTsdT | sense |
| 2089-2108 | 267 | GCUGGGGGGGCAAGUUGA | 268 | GCUGGGGGGGcAAGUUGAdTsdT | antis |
| 2231-2250 | 269 | GUUCAAUAAAUUAUUGGCA | 270 | GuucAAuAAAuuAuuGGcAdTsdT | sense |
| 2231-2250 | 271 | UGCCAAUAAUUUAUUGAAC | 272 | UGCcAAuAAUUuAUUGAACdTsdT | antis |
| 207-226 | 273 | CCUUCGGGAGGCGGCCCUG | 274 | ccuucGGGAGGcGGcccuGdTsdT | sense |
| 207-226 | 275 | CAGGGCCGCCUCCCGAAGG | 276 | cAGGGCCGCCUCCCGAAGGdTsdT | antis |
| 240-259 | 277 | GCGCGGACCAGCUCGUUCG | 278 | GcGcGGAccAGcucGuucGdTsdT | sense |
| 240-259 | 279 | CGAACGAGCUGGUCCGCGC | 280 | CGAACGAGCUGGUCCGCGCdTsdT | antis |
| 242-261 | 281 | GCGGACCAGCUCGUUCGCG | 282 | GcGGAccAGcucGuucGcGdTsdT | sense |
| 242-261 | 283 | CGCGAACGAGCUGGUCCGC | 284 | CGCGAACGAGCUGGUCCGCdTsdT | antis |
| 249-268 | 285 | AGCUCGUUCGCGGAGCCAG | 286 | AGcucGuucGcGGAGccAGdTsdT | sense |
| 249-268 | 287 | CUGGCUCCGCGAACGAGCU | 288 | CUGGCUCCGCGAACGAGCUdTsdT | antis |
| 252-271 | 289 | UCGUUCGCGGAGCCAGGAG | 290 | ucGuucGcGGAGccAGGAGdTsdT | sense |
| 252-271 | 291 | CUCCUGGCUCCGCGAACGA | 292 | CUCCUGGCUCCGCGAACGAdTsdT | antis |
| 324-343 | 293 | GGCACUGGCGGCGGGAAAG | 294 | GGcAcuGGcGGcGGGAAAGdTsdT | sense |
| 324-343 | 295 | CUUUCCCGCCGCCAGUGCC | 296 | CUUUCCCGCCGCcAGUGCCdTsdT | antis |
| 329-348 | 297 | UGGCGGCGGGAAAGCGUCA | 298 | uGGcGGcGGGAAAGcGucAdTsdT | sense |
| 329-348 | 299 | UGACGCUUUCCCGCCGCCA | 300 | UGACGCUUUCCCGCCGCcAdTsdT | antis |
| 427-446 | 301 | GCCCCGGCGCGGGCACUAG | 302 | GccccGGcGcGGGcAcuAGdTsdT | sense |
| 427-446 | 303 | CUAGUGCCCGCGCCGGGGC | 304 | CuAGUGCCCGCGCCGGGGCdTsdT | antis |
| 428-447 | 305 | CCCCGGCGCGGGCACUAGC | 306 | ccccGGcGcGGGcAcuAGcdTsdT | sense |
| 428-447 | 307 | GCUAGUGCCCGCGCCGGGG | 308 | GCuAGUGCCCGCGCCGGGGdTsdT | antis |
| 429-448 | 309 | CCCGGCGCGGGCACUAGCU | 310 | cccGGcGcGGGcAcuAGcudTsdT | sense |
| 429-448 | 311 | AGCUAGUGCCCGCGCCGGG | 312 | AGCuAGUGCCCGCGCCGGGdTsdT | antis |
| 430-449 | 313 | CCGGCGCGGGCACUAGCUU | 314 | ccGGcGcGGGcAcuAGcuudTsdT | sense |
| 430-449 | 315 | AAGCUAGUGCCCGCGCCGG | 316 | AAGCuAGUGCCCGCGCCGGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 438-457 | 317 | GGCACUAGCUUCCCGCCGC | 318 | GGcAcuAGcuucccGccGcdTsdT | sense |
| 438-457 | 319 | GCGGCGGGAAGCUAGUGCC | 320 | GCGGCGGGAAGCuAGUGCCdTsdT | antis |
| 583-602 | 321 | GAGUAGUAUACCAGGCACG | 322 | GAGuAGuAuAccAGGcAcGdTsdT | sense |
| 583-602 | 323 | CGUGCCUGGUAUACUACUC | 324 | CGUGCCUGGuAuACuACUCdTsdT | antis |
| 654-673 | 325 | AGGUUCAAGAACCGAGAAC | 326 | AGGuucAAGAAccGAGAAcdTsdT | sense |
| 654-673 | 327 | GUUCUCGGUUCUUGAACCU | 328 | GUUCUCGGUUCUUGAACCUdTsdT | antis |
| 667-686 | 329 | GAGAACUGCAGAUUAUGCG | 330 | GAGAAcuGcAGAuuAuGcGdTsdT | sense |
| 667-686 | 331 | CGCAUAAUCUGCAGUUCUC | 332 | CGcAuAAUCUGcAGUUCUCdTsdT | antis |
| 928-947 | 333 | AGCCCCAGAAUUUGCUUGU | 334 | AGccccAGAAuuuGcuuGudTsdT | sense |
| 928-947 | 335 | ACAAGCAAAUUCUGGGGCU | 336 | AcAAGcAAAUUCUGGGGCUdTsdT | antis |
| 994-1013 | 337 | AGCAGCUGGUUCGGGGGA | 338 | AGcAGcuGGuucGGGGGAdTsdT | sense |
| 994-1013 | 339 | UCCCCCCGAACCAGCUGCU | 340 | UCCCCCCGAACcAGCUGCUdTsdT | antis |
| 1005-1024 | 341 | CGGGGGGAGCCCAAUGUGU | 342 | cGGGGGGAGcccAAuGuGudTsdT | sense |
| 1005-1024 | 343 | ACACAUUGGGCUCCCCCCG | 344 | AcAcAUUGGGCUCCCCCCGdTsdT | antis |
| 1008-1027 | 345 | GGGGAGCCCAAUGUGUCCU | 346 | GGGGAGcccAAuGuGuccudTsdT | sense |
| 1008-1027 | 347 | AGGACACAUUGGGCUCCCC | 348 | AGGAcAcAUUGGGCUCCCCdTsdT | antis |
| 1124-1143 | 349 | UGAGCUACUUCUCGGCCAG | 350 | uGAGcuAcuucucGGccAGdTsdT | sense |
| 1124-1143 | 351 | CUGGCCGAGAAGUAGCUCA | 352 | CUGGCCGAGAAGuAGCUcAdTsdT | antis |
| 1303-1322 | 353 | CAAAGACACCACCUGAGGC | 354 | cAAAGAcAccAccuGAGGcdTsdT | sense |
| 1303-1322 | 355 | GCCUCAGGUGGUGUCUUUG | 356 | GCCUcAGGUGGUGUCUUUGdTsdT | antis |
| 1311-1330 | 357 | CCACCUGAGGCCAUUGCAC | 358 | ccAccuGAGGccAuuGcAcdTsdT | sense |
| 1311-1330 | 359 | GUGCAAUGGCCUCAGGUGG | 360 | GUGcAAUGGCCUcAGGUGGdTsdT | antis |
| 1444-1463 | 361 | GCCCGCUUCCCCCCCUGUU | 362 | GcccGcuucccccccuGuudTsdT | sense |
| 1444-1463 | 363 | AACAGGGGGGAAGCGGGC | 364 | AAcAGGGGGGAAGCGGGCdTsdT | antis |
| 1488-1507 | 365 | AUCCAACCAUCUCUCAAUG | 366 | AuccAAccAucucucAAuGdTsdT | sense |
| 1488-1507 | 367 | CAUUGAGAGAUGGUUGGAU | 368 | cAUUGAGAGAUGGUUGGAUdTsdT | antis |
| 1851-1870 | 369 | AUUUUAACUGUUUGUAGGG | 370 | AuuuuAAcuGuuuGuAGGGdTsdT | sense |
| 1851-1870 | 371 | CCCUACAAACAGUUAAAAU | 372 | CCCuAcAAAcAGUuAAAAUdTsdT | antis |
| 1852-1871 | 373 | UUUUAACUGUUUGUAGGGG | 374 | uuuuAAcuGuuuGuAGGGGdTsdT | sense |
| 1852-1871 | 375 | CCCCUACAAACAGUUAAAA | 376 | CCCCuAcAAAcAGUuAAAAdTsdT | antis |
| 1935-1954 | 377 | CUCCCCCAGGCUACCACUC | 378 | cucccccAGGcuAccAcucdTsdT | sense |
| 1935-1954 | 379 | GAGUGGUAGCCUGGGGGAG | 380 | GAGUGGuAGCCUGGGGGAGdTsdT | antis |
| 1975-1994 | 381 | GGUCCCUUGUAAAUAGAAC | 382 | GGucccuuGuAAAuAGAAcdTsdT | sense |
| 1975-1994 | 383 | GUUCUAUUUACAAGGGACC | 384 | GUUCuAUUuAcAAGGGACCdTsdT | antis |
| 2029-2048 | 385 | CCCCUGGGUGUAAAUAGAU | 386 | ccccuGGGuGuAAAuAGAudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2029-2048 | 387 | AUCUAUUUACACCCAGGGG | 388 | AUCuAUUuAcACCcAGGGGdTsdT | antis |
| 2033-2052 | 389 | UGGGUGUAAAUAGAUUGUU | 390 | uGGGuGuAAAuAGAuuGuudTsdT | sense |
| 2033-2052 | 391 | AACAAUCUAUUUACACCCA | 392 | AAcAAUCuAUUuAcACCcAdTsdT | antis |
| 2062-2081 | 393 | CUUAAAGAAAACGUCAAUU | 394 | cuuAAAGAAAAcGucAAuudTsdT | sense |
| 2062-2081 | 395 | AAUUGACGUUUUCUUUAAG | 396 | AAUUGACGUUUUCUUuAAGdTsdT | antis |
| 2063-2082 | 397 | UUAAAGAAAACGUCAAUUC | 398 | uuAAAGAAAAcGucAAuucdTsdT | sense |
| 2063-2082 | 399 | GAAUUGACGUUUUCUUUAA | 400 | GAAUUGACGUUUUCUUuAAdTsdT | antis |
| 2078-2097 | 401 | AUUCACACCAUUCAACUUG | 402 | AuucAcAccAuucAAcuuGdTsdT | sense |
| 2078-2097 | 403 | CAAGUUGAAUGGUGUGAAU | 404 | cAAGUUGAAUGGUGUGAAUdTsdT | antis |
| 2082-2101 | 405 | ACACCAUUCAACUUGCCCC | 406 | AcAccAuucAAcuuGccccdTsdT | sense |
| 2082-2101 | 407 | GGGGCAAGUUGAAUGGUGU | 408 | GGGGcAAGUUGAAUGGUGUdTsdT | antis |
| 2181-2200 | 409 | UCCCUGGUGUCUUAGUUUC | 410 | ucccuGGuGucuuAGuuucdTsdT | sense |
| 2181-2200 | 411 | GAAACUAAGACACCAGGGA | 412 | GAAACuAAGAcACcAGGGAdTsdT | antis |
| 2197-2216 | 413 | UUCCACAGUAAGGUUUGCC | 414 | uuccAcAGuAAGGuuuGccdTsdT | sense |
| 2197-2216 | 415 | GGCAAACCUUACUGUGGAA | 416 | GGcAAACCUuACUGUGGAAdTsdT | antis |
| 2209-2228 | 417 | GUUUGCCUGUGUACAGACC | 418 | GuuuGccuGuGuAcAGAccdTsdT | sense |
| 2209-2228 | 419 | GGUCUGUACACAGGCAAAC | 420 | GGUCUGuAcAcAGGcAAACdTsdT | antis |
| 2232-2251 | 421 | UUCAAUAAAUUAUUGGCAU | 422 | uucAAuAAAuuAuuGGcAudTsdT | sense |
| 2232-2251 | 423 | AUGCCAAUAAUUUAUUGAA | 424 | AUGCcAAuAAUUuAUUGAAdTsdT | antis |
| 2235-2254 | 425 | AAUAAAUUAUUGGCAUGAA | 426 | AAuAAAuuAuuGGcAuGAAdTsdT | sense |
| 2235-2254 | 427 | UUCAUGCCAAUAAUUUAUU | 428 | UUcAUGCcAAuAAUUuAUUdTsdT | antis |
| 2243-2262 | 429 | AUUGGCAUGAAACCCUUAA | 430 | AuuGGcAuGAAAcccuuAAdTsdT | sense |
| 2243-2262 | 431 | UUAAGGGUUUCAUGCCAAU | 432 | UuAAGGGUUUcAUGCcAAUdTsdT | antis |
| 336-355 | 433 | GGGAAAGCGUCAGUCGGGG | 434 | GGGAAAGcGucAGucGGGGdTsdT | sense |
| 336-355 | 435 | CCCCGACUGACGCUUUCCC | 436 | CCCCGACUGACGCUUUCCCdTsdT | antis |
| 894-913 | 437 | AUCCACUCCCAAGGUGUGU | 438 | AuccAcucccAAGGuGuGudTsdT | sense |
| 894-913 | 439 | ACACACCUUGGGAGUGGAU | 440 | AcAcACCUUGGGAGUGGAUdTsdT | antis |
| 1070-1089 | 441 | AGCCACAGAUUACACCUCG | 442 | AGccAcAGAuuAcAccucGdTsdT | sense |
| 1070-1089 | 443 | CGAGGUGUAAUCUGUGGCU | 444 | CGAGGUGuAAUCUGUGGCUdTsdT | antis |
| 1346-1365 | 445 | GGAGUACACGCCAUCCUCA | 446 | GGAGuAcAcGccAuccucAdTsdT | sense |
| 1346-1365 | 447 | UGAGGAUGGCGUGUACUCC | 448 | UGAGGAUGGCGUGuACUCCdTsdT | antis |
| 1976-1995 | 449 | GUCCCUUGUAAAUAGAACC | 450 | GucccuuGuAAAuAGAAccdTsdT | sense |
| 1976-1995 | 451 | GGUUCUAUUUACAAGGGAC | 452 | GGUUCuAUUuAcAAGGGACdTsdT | antis |
| 1977-1996 | 453 | UCCCUUGUAAAUAGAACCA | 454 | ucccuuGuAAAuAGAAccAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1977-1996 | 455 | UGGUUCUAUUUACAAGGGA | 456 | UGGUUCuAUUuAcAAGGGAdTsdT | antis |
| 2194-2213 | 457 | AGUUUCCACAGUAAGGUUU | 458 | AGuuuccAcAGuAAGGuuudTsdT | sense |
| 2194-2213 | 459 | AAACCUUACUGUGGAAACU | 460 | AAACCUuACUGUGGAAACUdTsdT | antis |
| 1229-1248 | 461 | GAUGAACCCUAACUAUACG | 462 | GAuGAAcccuAAcuAuAcGdTsdT | sense |
| 1229-1248 | 463 | CGUAUAGUUAGGGUUCAUC | 464 | CGuAuAGUuAGGGUUcAUCdTsdT | antis |
| 341-360 | 465 | AGCGUCAGUCGGGGCUAUG | 466 | AGcGucAGucGGGGcuAuGdTsdT | sense |
| 341-360 | 467 | CAUAGCCCCGACUGACGCU | 468 | cAuAGCCCCGACUGACGCUdTsdT | antis |
| 574-593 | 469 | GCUCAUUCGGAGUAGUAUA | 470 | GcucAuucGGAGuAGuAuAdTsdT | sense |
| 574-593 | 471 | UAUACUACUCCGAAUGAGC | 472 | uAuACuACUCCGAAUGAGCdTsdT | antis |
| 578-597 | 473 | AUUCGGAGUAGUAUACCAG | 474 | AuucGGAGuAGuAuAccAGdTsdT | sense |
| 578-597 | 475 | CUGGUAUACUACUCCGAAU | 476 | CUGGuAuACuACUCCGAAUdTsdT | antis |
| 672-691 | 477 | CUGCAGAUUAUGCGUAAGC | 478 | cuGcAGAuuAuGcGuAAGcdTsdT | sense |
| 672-691 | 479 | GCUUACGCAUAAUCUGCAG | 480 | GCUuACGcAuAAUCUGcAGdTsdT | antis |
| 673-692 | 481 | UGCAGAUUAUGCGUAAGCU | 482 | uGcAGAuuAuGcGuAAGcudTsdT | sense |
| 673-692 | 483 | AGCUUACGCAUAAUCUGCA | 484 | AGCUuACGcAuAAUCUGcAdTsdT | antis |
| 674-693 | 485 | GCAGAUUAUGCGUAAGCUG | 486 | GcAGAuuAuGcGuAAGcuGdTsdT | sense |
| 674-693 | 487 | CAGCUUACGCAUAAUCUGC | 488 | cAGCUuACGcAuAAUCUGCdTsdT | antis |
| 1433-1452 | 489 | CCCCAACGACCGCCCGCUU | 490 | ccccAAcGAccGcccGcuudTsdT | sense |
| 1433-1452 | 491 | AAGCGGGCGGUCGUUGGGG | 492 | AAGCGGGCGGUCGUUGGGGdTsdT | antis |
| 1434-1453 | 493 | CCCAACGACCGCCCGCUUC | 494 | cccAAcGAccGcccGcuucdTsdT | sense |
| 1434-1453 | 495 | GAAGCGGGCGGUCGUUGGG | 496 | GAAGCGGGCGGUCGUUGGGdTsdT | antis |
| 1640-1659 | 497 | UGCUACCCUCGCUAGCUCU | 498 | uGcuAcccucGcuAGcucudTsdT | sense |
| 1640-1659 | 499 | AGAGCUAGCGAGGGUAGCA | 500 | AGAGCuAGCGAGGGuAGcAdTsdT | antis |
| 458-477 | 501 | GGGAGUGAAGCUGGGCCGU | 502 | GGGAGuGAAGcuGGGccGudTsdT | sense |
| 458-477 | 503 | ACGGCCCAGCUUCACUCCC | 504 | ACGGCCcAGCUUcACUCCCdTsdT | antis |
| 459-478 | 505 | GGAGUGAAGCUGGGCCGUG | 506 | GGAGuGAAGcuGGGccGuGdTsdT | sense |
| 459-478 | 507 | CACGGCCCAGCUUCACUCC | 508 | cACGGCCcAGCUUcACUCCdTsdT | antis |
| 573-592 | 509 | GGCUCAUUCGGAGUAGUAU | 510 | GGcucAuucGGAGuAGuAudTsdT | sense |
| 573-592 | 511 | AUACUACUCCGAAUGAGCC | 512 | AuAcuACUCCGAAUGAGCCdTsdT | antis |
| 575-594 | 513 | CUCAUUCGGAGUAGUAUAC | 514 | cucAuucGGAGuAGuAuAcdTsdT | sense |
| 575-594 | 515 | GUAUACUACUCCGAAUGAG | 516 | GuAuACuACUCCGAAUGAGdTsdT | antis |
| 576-595 | 517 | UCAUUCGGAGUAGUAUACC | 518 | ucAuucGGAGuAGuAuAccdTsdT | sense |
| 576-595 | 519 | GGUAUACUACUCCGAAUGA | 520 | GGuAuAcuACUCCGAAUGAdTsdT | antis |
| 577-596 | 521 | CAUUCGGAGUAGUAUACCA | 522 | cAuucGGAGuAGuAuAccAdTsdT | sense |
| 577-596 | 523 | UGGUAUACUACUCCGAAUG | 524 | UGGuAuACuACUCCGAAUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 579-598 | 525 | UUCGGAGUAGUAUACCAGG | 526 | uucGGAGuAGuAuAccAGGdTsdT | sense |
| 579-598 | 527 | CCUGGUAUACUACUCCGAA | 528 | CCUGGuAuACuACUCCGAAdTsdT | antis |
| 671-690 | 529 | ACUGCAGAUUAUGCGUAAG | 530 | AcuGcAGAuuAuGcGuAAGdTsdT | sense |
| 671-690 | 531 | CUUACGCAUAAUCUGCAGU | 532 | CUuACGcAuAAUCUGcAGUdTsdT | antis |
| 786-805 | 533 | CCCGAGACGGUGUACCGAG | 534 | cccGAGAcGGuGuAccGAGdTsdT | sense |
| 786-805 | 535 | CUCGGUACACCGUCUCGGG | 536 | CUCGGuAcACCGUCUCGGGdTsdT | antis |
| 787-806 | 537 | CCGAGACGGUGUACCGAGU | 538 | ccGAGAcGGuGuAccGAGudTsdT | sense |
| 787-806 | 539 | ACUCGGUACACCGUCUCGG | 540 | ACUCGGuAcACCGUCUCGGdTsdT | antis |
| 789-808 | 541 | GAGACGGUGUACCGAGUGG | 542 | GAGAcGGuGuAccGAGuGGdTsdT | sense |
| 789-808 | 543 | CCACUCGGUACACCGUCUC | 544 | CcACUCGGuAcACCGUCUCdTsdT | antis |
| 1065-1084 | 545 | UUUGGAGCCACAGAUUACA | 546 | uuuGGAGccAcAGAuuAcAdTsdT | sense |
| 1065-1084 | 547 | UGUAAUCUGUGGCUCCAAA | 548 | UGuAAUCUGUGGCUCcAAAdTsdT | antis |
| 1226-1245 | 549 | AGAGAUGAACCCUAACUAU | 550 | AGAGAuGAAcccuAAcuAudTsdT | sense |
| 1226-1245 | 551 | AUAGUUAGGGUUCAUCUCU | 552 | AuAGUuAGGGUUcAUCUCUdTsdT | antis |
| 1228-1247 | 553 | AGAUGAACCCUAACUAUAC | 554 | AGAuGAAcccuAAcuAuAcdTsdT | sense |
| 1228-1247 | 555 | GUAUAGUUAGGGUUCAUCU | 556 | GuAuAGUuAGGGUUcAUCUdTsdT | antis |
| 1636-1655 | 557 | CAACUGCUACCCUCGCUAG | 558 | cAAcuGcuAcccucGcuAGdTsdT | sense |
| 1636-1655 | 559 | CUAGCGAGGGUAGCAGUUG | 560 | CuAGCGAGGGuAGcAGUUGdTsdT | antis |
| 1639-1658 | 561 | CUGCUACCCUCGCUAGCUC | 562 | cuGcuAcccucGcuAGcucdTsdT | sense |
| 1639-1658 | 563 | GAGCUAGCGAGGGUAGCAG | 564 | GAGCuAGCGAGGGuAGcAGdTsdT | antis |
| 2036-2055 | 565 | GUGUAAAUAGAUUGUUAUA | 566 | GuGuAAAuAGAuuGuuAuAdTsdT | sense |
| 2036-2055 | 567 | UAUAACAAUCUAUUUACAC | 568 | uAuAAcAAUCuAUUuAcACdTsdT | antis |
| 426-445 | 569 | GGCCCCGGCGCGGGCACUA | 570 | GGccccGGcGcGGGcAcuAdTsdT | sense |
| 426-445 | 571 | UAGUGCCCGCGCCGGGGCC | 572 | uAGUGCCCGCGCCGGGGCCdTsdT | antis |
| 883-902 | 573 | GCUUGGCCUACAUCCACUC | 574 | GcuuGGccuAcAuccAcucdTsdT | sense |
| 883-902 | 575 | GAGUGGAUGUAGGCCAAGC | 576 | GAGUGGAUGuAGGCcAAGCdTsdT | antis |
| 1227-1246 | 577 | GAGAUGAACCCUAACUAUA | 578 | GAGAuGAAcccuAAcuAuAdTsdT | sense |
| 1227-1246 | 579 | UAUAGUUAGGGUUCAUCUC | 580 | uAuAGUuAGGGUUcAUCUCdTsdT | antis |
| 1369-1388 | 581 | UCUCCCCACUCGAGGCUUG | 582 | ucuccccAcucGAGGcuuGdTsdT | sense |
| 1369-1388 | 583 | CAAGCCUCGAGUGGGGAGA | 584 | cAAGCCUCGAGUGGGGAGAdTsdT | antis |
| 1393-1412 | 585 | ACAGCUUCUUCGAUGAACU | 586 | AcAGcuucuucGAuGAAcudTsdT | sense |
| 1393-1412 | 587 | AGUUCAUCGAAGAAGCUGU | 588 | AGUUcAUCGAAGAAGCUGUdTsdT | antis |
| 1431-1450 | 589 | CUCCCCAACGACCGCCCGC | 590 | cuccccAAcGAccGcccGcdTsdT | sense |
| 1431-1450 | 591 | GCGGGCGGUCGUUGGGGAG | 592 | GCGGGCGGUCGUUGGGGAGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1436-1455 | 593 | CAACGACCGCCCGCUUCCC | 594 | cAAcGAccGcccGcuucccdTsdT | sense |
| 1436-1455 | 595 | GGGAAGCGGGCGGUCGUUG | 596 | GGGAAGCGGGCGGUCGUUGdTsdT | antis |
| 1437-1456 | 597 | AACGACCGCCCGCUUCCCC | 598 | AAcGAccGcccGcuuccccdTsdT | sense |
| 1437-1456 | 599 | GGGGAAGCGGGCGGUCGUU | 600 | GGGGAAGCGGGCGGUCGUUdTsdT | antis |
| 2176-2195 | 601 | GAGAGUCCCUGGUGUCUUA | 602 | GAGAGucccuGGuGucuuAdTsdT | sense |
| 2176-2195 | 603 | UAAGACACCAGGGACUCUC | 604 | uAAGAcAccAGGGACUCUCdTsdT | antis |
| 599-618 | 605 | ACGGCUGGCAGAGACGAGG | 606 | AcGGcuGGcAGAGAcGAGGdTsdT | sense |
| 599-618 | 607 | CCUCGUCUCUGCCAGCCGU | 608 | CCUCGUCUCUGCcAGCCGUdTsdT | antis |
| 706-725 | 609 | UUGUGAGGCUGCGGUACUU | 610 | uuGuGAGGcuGcGGuAcuudTsdT | sense |
| 706-725 | 611 | AAGUACCGCAGCCUCACAA | 612 | AAGuACCGcAGCCUcAcAAdTsdT | antis |
| 707-726 | 613 | UGUGAGGCUGCGGUACUUU | 614 | uGuGAGGcuGcGGuAcuuudTsdT | sense |
| 707-726 | 615 | AAAGUACCGCAGCCUCACA | 616 | AAAGuACCGcAGCCUcAcAdTsdT | antis |
| 791-810 | 617 | GACGGUGUACCGAGUGGCC | 618 | GAcGGuGuAccGAGuGGccdTsdT | sense |
| 791-810 | 619 | GGCCACUCGGUACACCGUC | 620 | GGCcACUCGGuAcACCGUCdTsdT | antis |
| 899-918 | 621 | CUCCCAAGGUGUGUGUCAC | 622 | cucccAAGGuGuGuGucAcdTsdT | sense |
| 899-918 | 623 | GUGACACACACCUUGGGAG | 624 | GUGAcAcAcACCUUGGGAGdTsdT | antis |
| 989-1008 | 625 | UGCAAAGCAGCUGGUUCGG | 626 | uGcAAAGcAGcuGGuucGGdTsdT | sense |
| 989-1008 | 627 | CCGAACCAGCUGCUUUGCA | 628 | CCGAAccAGCUGCUUUGcAdTsdT | antis |
| 1064-1083 | 629 | CUUUGGAGCCACAGAUUAC | 630 | cuuuGGAGccAcAGAuuAcdTsdT | sense |
| 1064-1083 | 631 | GUAAUCUGUGGCUCCAAAG | 632 | GuAAUCUGUGGCUCcAAAGdTsdT | antis |
| 1066-1085 | 633 | UUGGAGCCACAGAUUACAC | 634 | uuGGAGccAcAGAuuAcAcdTsdT | sense |
| 1066-1085 | 635 | GUGUAAUCUGUGGCUCCAA | 636 | GUGuAAUCUGUGGCUCcAAdTsdT | antis |
| 1125-1144 | 637 | GAGCUACUUCUCGGCCAGC | 638 | GAGcuAcuucucGGccAGcdTsdT | sense |
| 1125-1144 | 639 | GCUGGCCGAGAAGUAGCUC | 640 | GCUGGCCGAGAAGuAGCUCdTsdT | antis |
| 1225-1244 | 641 | GAGAGAUGAACCCUAACUA | 642 | GAGAGAuGAAcccuAAcuAdTsdT | sense |
| 1225-1244 | 643 | UAGUUAGGGUUCAUCUCUC | 644 | uAGUuAGGGUUcAUCUCUCdTsdT | antis |
| 1265-1284 | 645 | GAUCAAAGCUCACCCUUGG | 646 | GAucAAAGcucAcccuuGGdTsdT | sense |
| 1265-1284 | 647 | CCAAGGGUGAGCUUUGAUC | 648 | CcAAGGGUGAGCUUUGAUCdTsdT | antis |
| 1269-1288 | 649 | AAAGCUCACCCUUGGACAA | 650 | AAAGcucAcccuuGGAcAAdTsdT | sense |
| 1269-1288 | 651 | UUGUCCAAGGGUGAGCUUU | 652 | UUGUCcAAGGGUGAGCUUUdTsdT | antis |
| 1365-1384 | 653 | AGGCUCUCCCCACUCGAGG | 654 | AGGcucuccccAcucGAGGdTsdT | sense |
| 1365-1384 | 655 | CCUCGAGUGGGGAGAGCCU | 656 | CCUCGAGUGGGGAGAGCCUdTsdT | antis |
| 1481-1500 | 657 | ACUGUCCAUCCAACCAUCU | 658 | AcuGuccAuccAAccAucudTsdT | sense |
| 1481-1500 | 659 | AGAUGGUUGGAUGGACAGU | 660 | AGAUGGUUGGAUGGAcAGUdTsdT | antis |
| 1637-1656 | 661 | AACUGCUACCCUCGCUAGC | 662 | AAcuGcuAcccucGcuAGcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1637-1656 | 663 | GCUAGCGAGGGUAGCAGUU | 664 | GCuAGCGAGGGuAGcAGUUdTsdT | antis |
| 1979-1998 | 665 | CCUUGUAAAUAGAACCAGC | 666 | ccuuGuAAAuAGAAccAGcdTsdT | sense |
| 1979-1998 | 667 | GCUGGUUCUAUUUACAAGG | 668 | GCUGGUUCuAUUuAcAAGGdTsdT | antis |
| 2196-2215 | 669 | UUUCCACAGUAAGGUUUGC | 670 | uuuccAcAGuAAGGuuuGcdTsdT | sense |
| 2196-2215 | 671 | GCAAACCUUACUGUGGAAA | 672 | GcAAACCUuACUGUGGAAAdTsdT | antis |
| 1978-1997 | 673 | CCCUUGUAAAUAGAACCAG | 674 | cccuuGuAAAuAGAAccAGdTsdT | sense |
| 1978-1997 | 675 | CUGGUUCUAUUUACAAGGG | 676 | CUGGUUCuAUUuAcAAGGGdTsdT | antis |
| 651-670 | 677 | AAAAGGUUCAAGAACCGAG | 678 | AAAAGGuucAAGAAccGAGdTsdT | sense |
| 651-670 | 679 | CUCGGUUCUUGAACCUUUU | 680 | CUCGGUUCUUGAACCUUUUdTsdT | antis |
| 702-721 | 681 | AAUAUUGUGAGGCUGCGGU | 682 | AAuAuuGuGAGGcuGcGGudTsdT | sense |
| 702-721 | 683 | ACCGCAGCCUCACAAUAUU | 684 | ACCGcAGCCUcAcAAuAUUdTsdT | antis |
| 1363-1382 | 685 | CAAGGCUCUCCCCACUCGA | 686 | cAAGGcucuccccAcucGAdTsdT | sense |
| 1363-1382 | 687 | UCGAGUGGGGAGAGCCUUG | 688 | UCGAGUGGGGAGAGCCUUGdTsdT | antis |
| 701-720 | 689 | CAAUAUUGUGAGGCUGCGG | 690 | cAAuAuuGuGAGGcuGcGGdTsdT | sense |
| 701-720 | 691 | CCGCAGCCUCACAAUAUUG | 692 | CCGcAGCCUcAcAAuAUUGdTsdT | antis |
| 1237-1256 | 693 | CUAACUAUACGGAGUUCAA | 694 | cuAAcuAuAcGGAGuucAAdTsdT | sense |
| 1237-1256 | 695 | UUGAACUCCGUAUAGUUAG | 696 | UUGAACUCCGuAuAGUuAGdTsdT | antis |
| 2064-2083 | 697 | UAAAGAAAACGUCAAUUCA | 698 | uAAAGAAAAcGucAAuucAdTsdT | sense |
| 2064-2083 | 699 | UGAAUUGACGUUUUCUUUA | 700 | UGAAUUGACGUUUUCUUuAdTsdT | antis |
| 828-847 | 701 | AAGCUGAUCACCCCUAUCA | 702 | AAGcuGAucAccccuAucAdTsdT | sense |
| 828-847 | 703 | UGAUAGGGGUGAUCAGCUU | 704 | UGAuAGGGGUGAUcAGCUUdTsdT | antis |
| 930-949 | 705 | CCCCAGAAUUUGCUUGUGG | 706 | ccccAGAAuuuGcuuGuGGdTsdT | sense |
| 930-949 | 707 | CCACAAGCAAAUUCUGGGG | 708 | CcAcAAGcAAAUUCUGGGGdTsdT | antis |
| 995-1014 | 709 | GCAGCUGGUUCGGGGGAG | 710 | GcAGcuGGuucGGGGGAGdTsdT | sense |
| 995-1014 | 711 | CUCCCCCCGAACCAGCUGC | 712 | CUCCCCCCGAACcAGCUGCdTsdT | antis |
| 1478-1497 | 713 | UGAACUGUCCAUCCAACCA | 714 | uGAAcuGuccAuccAAccAdTsdT | sense |
| 1478-1497 | 715 | UGGUUGGAUGGACAGUUCA | 716 | UGGUUGGAUGGAcAGUUcAdTsdT | antis |
| 1604-1623 | 717 | GACUGGCCAAGAUUGGCAG | 718 | GAcuGGccAAGAuuGGcAGdTsdT | sense |
| 1604-1623 | 719 | CUGCCAAUCUUGGCCAGUC | 720 | CUGCcAAUCUUGGCcAGUCdTsdT | antis |
| 1808-1827 | 721 | CUCCCUCAGCAGCCUAACC | 722 | cucccucAGcAGccuAAccdTsdT | sense |
| 1808-1827 | 723 | GGUUAGGCUGCUGAGGGAG | 724 | GGUuAGGCUGCUGAGGGAGdTsdT | antis |
| 2177-2196 | 725 | AGAGUCCCUGGUGUCUUAG | 726 | AGAGucccuGGuGucuuAGdTsdT | sense |
| 2177-2196 | 727 | CUAAGACACCAGGGACUCU | 728 | CuAAGAcACcAGGGACUCUdTsdT | antis |
| 82-101 | 729 | GAACGGCGCGGCCUGGAAG | 730 | GAAcGGcGcGGccuGGAAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 82-101 | 731 | CUUCCAGGCCGCGCCGUUC | 732 | CUUCcAGGCCGCGCCGUUCdTsdT | antis |
| 1077-1096 | 733 | GAUUACACCUCGUCCAUCG | 734 | GAuuAcAccucGuccAucGdTsdT | sense |
| 1077-1096 | 735 | CGAUGGACGAGGUGUAAUC | 736 | CGAUGGACGAGGUGuAAUCdTsdT | antis |
| 1238-1257 | 737 | UAACUAUACGGAGUUCAAG | 738 | uAAcuAuAcGGAGuucAAGdTsdT | sense |
| 1238-1257 | 739 | CUUGAACUCCGUAUAGUUA | 740 | CUUGAACUCCGuAuAGUuAdTsdT | antis |
| 248-267 | 741 | CAGCUCGUUCGCGGAGCCA | 742 | cAGcucGuucGcGGAGccAdTsdT | sense |
| 248-267 | 743 | UGGCUCCGCGAACGAGCUG | 744 | UGGCUCCGCGAACGAGCUGdTsdT | antis |
| 250-269 | 745 | GCUCGUUCGCGGAGCCAGG | 746 | GcucGuucGcGGAGccAGGdTsdT | sense |
| 250-269 | 747 | CCUGGCUCCGCGAACGAGC | 748 | CCUGGCUCCGCGAACGAGCdTsdT | antis |
| 327-346 | 749 | ACUGGCGGCGGGAAAGCGU | 750 | AcuGGcGGcGGGAAAGcGudTsdT | sense |
| 327-346 | 751 | ACGCUUUCCCGCCGCCAGU | 752 | ACGCUUUCCCGCCGCcAGUdTsdT | antis |
| 332-351 | 753 | CGGCGGGAAAGCGUCAGUC | 754 | cGGcGGGAAAGcGucAGucdTsdT | sense |
| 332-351 | 755 | GACUGACGCUUUCCCGCCG | 756 | GACUGACGCUUUCCCGCCGdTsdT | antis |
| 376-395 | 757 | CCUCGAGCUCCGGGGGUGG | 758 | ccucGAGcuccGGGGGuGGdTsdT | sense |
| 376-395 | 759 | CCACCCCCGGAGCUCGAGG | 760 | CcACCCCCGGAGCUCGAGGdTsdT | antis |
| 468-487 | 761 | CUGGGCCGUGACAGCGGGA | 762 | cuGGGccGuGAcAGcGGGAdTsdT | sense |
| 468-487 | 763 | UCCCGCUGUCACGGCCCAG | 764 | UCCCGCUGUcACGGCCCAGdTsdT | antis |
| 584-603 | 765 | AGUAGUAUACCAGGCACGG | 766 | AGuAGuAuAccAGGcAcGGdTsdT | sense |
| 584-603 | 767 | CCGUGCCUGGUAUACUACU | 768 | CCGUGCCUGGuAuACuACUdTsdT | antis |
| 785-804 | 769 | GCCCGAGACGGUGUACCGA | 770 | GcccGAGAcGGuGuAccGAdTsdT | sense |
| 785-804 | 771 | UCGGUACACCGUCUCGGGC | 772 | UCGGuAcACCGUCUCGGGCdTsdT | antis |
| 1010-1029 | 773 | GGAGCCCAAUGUGUCCUAC | 774 | GGAGcccAAuGuGuccuAcdTsdT | sense |
| 1010-1029 | 775 | GUAGGACACAUUGGGCUCC | 776 | GuAGGAcAcAUUGGGCUCCdTsdT | antis |
| 1011-1030 | 777 | GAGCCCAAUGUGUCCUACA | 778 | GAGcccAAuGuGuccuAcAdTsdT | sense |
| 1011-1030 | 779 | UGUAGGACACAUUGGGCUC | 780 | UGuAGGAcAcAUUGGGCUCdTsdT | antis |
| 1021-1040 | 781 | UGUCCUACAUCUGCUCUCG | 782 | uGuccuAcAucuGcucucGdTsdT | sense |
| 1021-1040 | 783 | CGAGAGCAGAUGUAGGACA | 784 | CGAGAGcAGAUGuAGGAcAdTsdT | antis |
| 1022-1041 | 785 | GUCCUACAUCUGCUCUCGG | 786 | GuccuAcAucuGcucucGGdTsdT | sense |
| 1022-1041 | 787 | CCGAGAGCAGAUGUAGGAC | 788 | CCGAGAGcAGAUGuAGGACdTsdT | antis |
| 1023-1042 | 789 | UCCUACAUCUGCUCUCGGU | 790 | uccuAcAucuGcucucGGudTsdT | sense |
| 1023-1042 | 791 | ACCGAGAGCAGAUGUAGGA | 792 | ACCGAGAGcAGAUGuAGGAdTsdT | antis |
| 1072-1091 | 793 | CCACAGAUUACACCUCGUC | 794 | ccAcAGAuuAcAccucGucdTsdT | sense |
| 1072-1091 | 795 | GACGAGGUGUAAUCUGUGG | 796 | GACGAGGUGuAAUCUGUGGdTsdT | antis |
| 1127-1146 | 797 | GCUACUUCUCGGCCAGCCC | 798 | GcuAcuucucGGccAGcccdTsdT | sense |
| 1127-1146 | 799 | GGGCUGGCCGAGAAGUAGC | 800 | GGGCUGGCCGAGAAGuAGCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1408-1427 | 801 | AACUGCGGAGACUCGGAGC | 802 | AAcuGcGGAGAcucGGAGcdTsdT | sense |
| 1408-1427 | 803 | GCUCCGAGUCUCCGCAGUU | 804 | GCUCCGAGUCUCCGcAGUUdTsdT | antis |
| 1432-1451 | 805 | UCCCCAACGACCGCCCGCU | 806 | uccccAAcGAccGcccGcudTsdT | sense |
| 1432-1451 | 807 | AGCGGGCGGUCGUUGGGGA | 808 | AGCGGGCGGUCGUUGGGGAdTsdT | antis |
| 1982-2001 | 809 | UGUAAAUAGAACCAGCCCA | 810 | uGuAAAuAGAAccAGcccAdTsdT | sense |
| 1982-2001 | 811 | UGGGCUGGUUCUAUUUACA | 812 | UGGGCUGGUUCuAUUuAcAdTsdT | antis |
| 2030-2049 | 813 | CCCUGGGUGUAAAUAGAUU | 814 | cccuGGGuGuAAAuAGAuudTsdT | sense |
| 2030-2049 | 815 | AAUCUAUUUACACCCAGGG | 816 | AAUCuAUUuAcAcCCcAGGGdTsdT | antis |
| 2073-2092 | 817 | CGUCAAUUCACACCAUUCA | 818 | cGucAAuucAcAccAuucAdTsdT | sense |
| 2073-2092 | 819 | UGAAUGGUGUGAAUUGACG | 820 | UGAAUGGUGUGAAUUGACGdTsdT | antis |
| 2218-2237 | 821 | UGUACAGACCUCUGUUCAA | 822 | uGuAcAGAccucuGuucAAdTsdT | sense |
| 2218-2237 | 823 | UUGAACAGAGGUCUGUACA | 824 | UUGAAcAGAGGUCUGuAcAdTsdT | antis |
| 2229-2248 | 825 | CUGUUCAAUAAAUUAUUGG | 826 | cuGuucAAuAAAuuAuuGGdTsdT | sense |
| 2229-2248 | 827 | CCAAUAAUUUAUUGAACAG | 828 | CcAAuAAUUuAUUGAAcAGdTsdT | antis |
| 7-26 | 829 | ACAACGAAGCCGACGGCAG | 830 | AcAAcGAAGccGAcGGcAGdTsdT | sense |
| 7-26 | 831 | CUGCCGUCGGCUUCGUUGU | 832 | CUGCCGUCGGCUUCGUUGUdTsdT | antis |
| 8-27 | 833 | CAACGAAGCCGACGGCAGA | 834 | cAAcGAAGccGAcGGcAGAdTsdT | sense |
| 8-27 | 835 | UCUGCCGUCGGCUUCGUUG | 836 | UCUGCCGUCGGCUUCGUUGdTsdT | antis |
| 76-95 | 837 | GAGCCCGAACGGCGCGGCC | 838 | GAGcccGAAcGGcGcGGccdTsdT | sense |
| 76-95 | 839 | GGCCGCGCCGUUCGGGCUC | 840 | GGCCGCGCCGUUCGGGCUCdTsdT | antis |
| 176-195 | 841 | GCCUGCGCUCGGCGCCAUG | 842 | GccuGcGcucGGcGccAuGdTsdT | sense |
| 176-195 | 843 | CAUGGCGCCGAGCGCAGGC | 844 | cAUGGCGCCGAGCGcAGGCdTsdT | antis |
| 434-453 | 845 | CGCGGGCACUAGCUUCCCG | 846 | cGcGGGcAcuAGcuucccGdTsdT | sense |
| 434-453 | 847 | CGGGAAGCUAGUGCCCGCG | 848 | CGGGAAGCuAGUGCCCGCGdTsdT | antis |
| 472-491 | 849 | GCCGUGACAGCGGGAAGGU | 850 | GccGuGAcAGcGGGAAGGudTsdT | sense |
| 472-491 | 851 | ACCUUCCCGCUGUCACGGC | 852 | ACCUUCCCGCUGUcACGGCdTsdT | antis |
| 537-556 | 853 | GAAGUGGCUUACACUGACA | 854 | GAAGuGGcuuAcAcuGAcAdTsdT | sense |
| 537-556 | 855 | UGUCAGUGUAAGCCACUUC | 856 | UGUcAGUGuAAGCcACUUCdTsdT | antis |
| 656-675 | 857 | GUUCAAGAACCGAGAACUG | 858 | GuucAAGAAccGAGAAcuGdTsdT | sense |
| 656-675 | 859 | CAGUUCUCGGUUCUUGAAC | 860 | cAGUUCUCGGUUCUUGAACdTsdT | antis |
| 657-676 | 861 | UUCAAGAACCGAGAACUGC | 862 | uucAAGAAccGAGAAcuGcdTsdT | sense |
| 657-676 | 863 | GCAGUUCUCGGUUCUUGAA | 864 | GcAGUUCUCGGUUCUUGAAdTsdT | antis |
| 784-803 | 865 | UGCCCGAGACGGUGUACCG | 866 | uGcccGAGAcGGuGuAccGdTsdT | sense |
| 784-803 | 867 | CGGUACACCGUCUCGGGCA | 868 | CGGuAcACCGUCUCGGGcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1404-1423 | 869 | GAUGAACUGCGGAGACUCG | 870 | GAuGAAcuGcGGAGAcucGdTsdT | sense |
| 1404-1423 | 871 | CGAGUCUCCGCAGUUCAUC | 872 | CGAGUCUCCGcAGUUcAUCdTsdT | antis |
| 1405-1424 | 873 | AUGAACUGCGGAGACUCGG | 874 | AuGAAcuGcGGAGAcucGGdTsdT | sense |
| 1405-1424 | 875 | CCGAGUCUCCGCAGUUCAU | 876 | CCGAGUCUCCGcAGUUcAUdTsdT | antis |
| 1445-1464 | 877 | CCCGCUUCCCCCCCUGUUC | 878 | cccGcuuccccccuGuucdTsdT | sense |
| 1445-1464 | 879 | GAACAGGGGGGGAAGCGGG | 880 | GAAcAGGGGGGGAAGCGGGdTsdT | antis |
| 1446-1465 | 881 | CCGCUUCCCCCCCUGUUCA | 882 | ccGcuuccccccuGuucAdTsdT | sense |
| 1446-1465 | 883 | UGAACAGGGGGGGAAGCGG | 884 | UGAAcAGGGGGGGAAGCGGdTsdT | antis |
| 1470-1489 | 885 | AGUCCUGGUGAACUGUCCA | 886 | AGuccuGGuGAAcuGuccAdTsdT | sense |
| 1470-1489 | 887 | UGGACAGUUCACCAGGACU | 888 | UGGAcAGUUcACcAGGACUdTsdT | antis |
| 1897-1916 | 889 | GGGGGUGUGAGGACCUUCU | 890 | GGGGGuGuGAGGAccuucudTsdT | sense |
| 1897-1916 | 891 | AGAAGGUCCUCACACCCCC | 892 | AGAAGGUCCUcAcACCCCCdTsdT | antis |
| 1937-1956 | 893 | CCCCCAGGCUACCACUCCU | 894 | cccccAGGcuAccAcuccudTsdT | sense |
| 1937-1956 | 895 | AGGAGUGGUAGCCUGGGGG | 896 | AGGAGUGGuAGCCUGGGGGdTsdT | antis |
| 1981-2000 | 897 | UUGUAAAUAGAACCAGCCC | 898 | uuGuAAAuAGAAccAGcccdTsdT | sense |
| 1981-2000 | 899 | GGGCUGGUUCUAUUUACAA | 900 | GGGCUGGUUCuAUUuAcAAdTsdT | antis |
| 1985-2004 | 901 | AAAUAGAACCAGCCCAGCC | 902 | AAAuAGAAccAGcccAGccdTsdT | sense |
| 1985-2004 | 903 | GGCUGGGCUGGUUCUAUUU | 904 | GGCUGGGCUGGUUCuAUUUdTsdT | antis |
| 2061-2080 | 905 | UCUUAAAGAAAACGUCAAU | 906 | ucuuAAAGAAAAcGucAAudTsdT | sense |
| 2061-2080 | 907 | AUUGACGUUUUCUUUAAGA | 908 | AUUGACGUUUUCUUuAAGAdTsdT | antis |
| 2065-2084 | 909 | AAAGAAAACGUCAAUUCAC | 910 | AAAGAAAAcGucAAuucAcdTsdT | sense |
| 2065-2084 | 911 | GUGAAUUGACGUUUUCUUU | 912 | GUGAAUUGACGUUUUCUUUdTsdT | antis |
| 1-20 | 913 | GUGGUGACAACGAAGCCGA | 914 | GuGGuGAcAAcGAAGccGAdTsdT | sense |
| 1-20 | 915 | UCGGCUUCGUUGUCACCAC | 916 | UCGGCUUCGUUGUcACcACdTsdT | antis |
| 11-30 | 917 | CGAAGCCGACGGCAGAGGG | 918 | cGAAGccGAcGGcAGAGGGdTsdT | sense |
| 11-30 | 919 | CCCUCUGCCGUCGGCUUCG | 920 | CCCUCUGCCGUCGGCUUCGdTsdT | antis |
| 70-89 | 921 | GAGCCGGAGCCCGAACGGC | 922 | GAGccGGAGcccGAAcGGCdTsdT | sense |
| 70-89 | 923 | GCCGUUCGGGCUCCGGCUC | 924 | GCCGUUCGGGCUCCGGCUCdTsdT | antis |
| 73-92 | 925 | CCGGAGCCCGAACGGCGCG | 926 | ccGGAGcccGAAcGGcGcGdTsdT | sense |
| 73-92 | 927 | CGCGCCGUUCGGGCUCCGG | 928 | CGCGCCGUUCGGGCUCCGGdTsdT | antis |
| 150-169 | 929 | CAGGCAGCCCGAGCCCCGC | 930 | cAGGcAGcccGAGccccGcdTsdT | sense |
| 150-169 | 931 | GCGGGGCUCGGGCUGCCUG | 932 | GCGGGGCUCGGGCUGCCUGdTsdT | antis |
| 178-197 | 933 | CUGCGCUCGGCGCCAUGAG | 934 | cuGcGcucGGcGccAuGAGdTsdT | sense |
| 178-197 | 935 | CUCAUGGCGCCGAGCGCAG | 936 | CUcAUGGCGCCGAGCGcAGdTsdT | antis |
| 180-199 | 937 | GCGCUCGGCGCCAUGAGCG | 938 | GcGcucGGcGccAuGAGcGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 180-199 | 939 | CGCUCAUGGCGCCGAGCGC | 940 | CGCUcAUGGCGCCGAGCGCdTsdT | antis |
| 196-215 | 941 | GCGGCGGCGGGCCUUCGGG | 942 | GcGGcGGcGGGccuucGGGdTsdT | sense |
| 196-215 | 943 | CCCGAAGGCCCGCCGCCGC | 944 | CCCGAAGGCCCGCCGCCGCdTsdT | antis |
| 202-221 | 945 | GCGGGCCUUCGGGAGGCGG | 946 | GcGGGccuucGGGAGGcGGdTsdT | sense |
| 202-221 | 947 | CCGCCUCCCGAAGGCCCGC | 948 | CCGCCUCCCGAAGGCCCGCdTsdT | antis |
| 223-242 | 949 | CUGGGGGCUCGGGCCGGGC | 950 | cuGGGGGcucGGGccGGGCdTsdT | sense |
| 223-242 | 951 | GCCCGGCCCGAGCCCCCAG | 952 | GCCCGGCCCGAGCCCCcAGdTsdT | antis |
| 238-257 | 953 | GGGCGCGGACCAGCUCGUU | 954 | GGGcGcGGAccAGcucGuudTsdT | sense |
| 238-257 | 955 | AACGAGCUGGUCCGCGCCC | 956 | AACGAGCUGGUCCGCGCCCdTsdT | antis |
| 317-336 | 957 | CCCAGGAGGCACUGGCGGC | 958 | cccAGGAGGcAcuGGcGGCdTsdT | sense |
| 317-336 | 959 | GCCGCCAGUGCCUCCUGGG | 960 | GCCGCcAGUGCCUCCUGGGdTsdT | antis |
| 337-356 | 961 | GGAAAGCGUCAGUCGGGC | 962 | GGAAAGcGucAGucGGGGCdTsdT | sense |
| 337-356 | 963 | GCCCCGACUGACGCUUUCC | 964 | GCCCCGACUGACGCUUUCCdTsdT | antis |
| 436-455 | 965 | CGGGCACUAGCUUCCCGCC | 966 | cGGGcAcuAGcuucccGccdTsdT | sense |
| 436-455 | 967 | GGCGGGAAGCUAGUGCCCG | 968 | GGCGGGAAGCuAGUGCCCGdTsdT | antis |
| 449-468 | 969 | CCCGCCGCCGGGAGUGAAG | 970 | cccGccGccGGGAGuGAAGdTsdT | sense |
| 449-468 | 971 | CUUCACUCCCGGCGGCGGG | 972 | CUUcACUCCCGGCGGCGGGdTsdT | antis |
| 464-483 | 973 | GAAGCUGGGCCGUGACAGC | 974 | GAAGcuGGGccGuGAcAGCdTsdT | sense |
| 464-483 | 975 | GCUGUCACGGCCCAGCUUC | 976 | GCUGUcACGGCCcAGCUUCdTsdT | antis |
| 534-553 | 977 | CAAGAAGUGGCUUACACUG | 978 | cAAGAAGuGGcuuAcAcuGdTsdT | sense |
| 534-553 | 979 | CAGUGUAAGCCACUUCUUG | 980 | cAGUGuAAGCcACUUCUUGdTsdT | antis |
| 535-554 | 981 | AAGAAGUGGCUUACACUGA | 982 | AAGAAGuGGcuuAcAcuGAdTsdT | sense |
| 535-554 | 983 | UCAGUGUAAGCCACUUCUU | 984 | UcAGUGuAAGCcACUUCUUdTsdT | antis |
| 536-555 | 985 | AGAAGUGGCUUACACUGAC | 986 | AGAAGuGGcuuAcAcuGAcdTsdT | sense |
| 536-555 | 987 | GUCAGUGUAAGCCACUUCU | 988 | GUcAGUGuAAGCcACUUCUdTsdT | antis |
| 821-840 | 989 | CAAGGCCAAGCUGAUCACC | 990 | cAAGGccAAGcuGAucAccdTsdT | sense |
| 821-840 | 991 | GGUGAUCAGCUUGGCCUUG | 992 | GGUGAUcAGCUUGGCCUUGdTsdT | antis |
| 826-845 | 993 | CCAAGCUGAUCACCCCUAU | 994 | ccAAGcuGAucAccccuAudTsdT | sense |
| 826-845 | 995 | AUAGGGGUGAUCAGCUUGG | 996 | AuAGGGGUGAUcAGCUUGGdTsdT | antis |
| 897-916 | 997 | CACUCCCAAGGUGUGUGUC | 998 | cAcucccAAGGuGuGuGucdTsdT | sense |
| 897-916 | 999 | GACACACACCUUGGGAGUG | 1000 | GAcAcAcACCUUGGGAGUGdTsdT | antis |
| 898-917 | 1001 | ACUCCCAAGGUGUGUGUCA | 1002 | AcucccAAGGuGuGuGucAdTsdT | sense |
| 898-917 | 1003 | UGACACACACCUUGGGAGU | 1004 | UGAcAcAcACCUUGGGAGUdTsdT | antis |
| 990-1009 | 1005 | GCAAAGCAGCUGGUUCGGG | 1006 | GcAAAGcAGcuGGuucGGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 990-1009 | 1007 | CCCGAACCAGCUGCUUUGC | 1008 | CCCGAACcAGCUGCUUUGCdTsdT | antis |
| 992-1011 | 1009 | AAAGCAGCUGGUUCGGGGG | 1010 | AAAGcAGcuGGuucGGGGGdTsdT | sense |
| 992-1011 | 1011 | CCCCCGAACCAGCUGCUUU | 1012 | CCCCCGAACcAGCUGCUUUdTsdT | antis |
| 996-1015 | 1013 | CAGCUGGUUCGGGGGAGC | 1014 | cAGcuGGuucGGGGGGAGCdTsdT | sense |
| 996-1015 | 1015 | GCUCCCCCGAACCAGCUG | 1016 | GCUCCCCCGAACcAGCUGdTsdT | antis |
| 1007-1026 | 1017 | GGGGGAGCCCAAUGUGUCC | 1018 | GGGGGAGcccAAuGuGuccdTsdT | sense |
| 1007-1026 | 1019 | GGACACAUUGGGCUCCCCC | 1020 | GGAcAcAUUGGGCUCCCCCdTsdT | antis |
| 1013-1032 | 1021 | GCCCAAUGUGUCCUACAUC | 1022 | GcccAAuGuGuccuAcAucdTsdT | sense |
| 1013-1032 | 1023 | GAUGUAGGACACAUUGGGC | 1024 | GAUGuAGGAcAcAUUGGGCdTsdT | antis |
| 1030-1049 | 1025 | UCUGCUCUCGGUACUACCG | 1026 | ucuGcucucGGuAcuAccGdTsdT | sense |
| 1030-1049 | 1027 | CGGUAGUACCGAGAGCAGA | 1028 | CGGuAGuACCGAGAGcAGAdTsdT | antis |
| 1104-1123 | 1029 | UCGGCUGGCUGUGUACUUG | 1030 | ucGGcuGGcuGuGuAcuuGdTsdT | sense |
| 1104-1123 | 1031 | CAAGUACACAGCCAGCCGA | 1032 | cAAGuAcAcAGCcAGCCGAdTsdT | antis |
| 1109-1128 | 1033 | UGGCUGUGUACUUGCUGAG | 1034 | uGGcuGuGuAcuuGcuGAGdTsdT | sense |
| 1109-1128 | 1035 | CUCAGCAAGUACACAGCCA | 1036 | CUcAGcAAGuAcAcAGCcAdTsdT | antis |
| 1120-1139 | 1037 | UUGCUGAGCUACUUCUCGG | 1038 | uuGcuGAGcuAcuucucGGdTsdT | sense |
| 1120-1139 | 1039 | CCGAGAAGUAGCUCAGCAA | 1040 | CCGAGAAGuAGCUcAGcAAdTsdT | antis |
| 1122-1141 | 1041 | GCUGAGCUACUUCUCGGCC | 1042 | GcuGAGcuAcuucucGGccdTsdT | sense |
| 1122-1141 | 1043 | GGCCGAGAAGUAGCUCAGC | 1044 | GGCCGAGAAGuAGCUcAGCdTsdT | antis |
| 1266-1285 | 1045 | AUCAAAGCUCACCCUUGGA | 1046 | AucAAAGcucAcccuuGGAdTsdT | sense |
| 1266-1285 | 1047 | UCCAAGGGUGAGCUUUGAU | 1048 | UCcAAGGGUGAGCUUUGAUdTsdT | antis |
| 1329-1348 | 1049 | CUCUGCUCUAGCCUACUGG | 1050 | cucuGcucuAGccuAcuGGdTsdT | sense |
| 1329-1348 | 1051 | CCAGUAGGCUAGAGCAGAG | 1052 | CcAGuAGGCuAGAGcAGAGdTsdT | antis |
| 1343-1362 | 1053 | ACUGGAGUACACGCCAUCC | 1054 | AcuGGAGuAcAcGccAuccdTsdT | sense |
| 1343-1362 | 1055 | GGAUGGCGUGUACUCCAGU | 1056 | GGAUGGCGUGuACUCcAGUdTsdT | antis |
| 1364-1383 | 1057 | AAGGCUCUCCCCACUCGAG | 1058 | AAGGcucuccccAcucGAGdTsdT | sense |
| 1364-1383 | 1059 | CUCGAGUGGGGAGAGCCUU | 1060 | CUcGAGUGGGGAGAGCCUUdTsdT | antis |
| 1411-1430 | 1061 | UGCGGAGACUCGGAGCCCA | 1062 | uGcGGAGAcucGGAGcccAdTsdT | sense |
| 1411-1430 | 1063 | UGGGCUCCGAGUCUCCGCA | 1064 | UGGGCUCCGAGUCUCCGcAdTsdT | antis |
| 1570-1589 | 1065 | ACAACCCAUCCUCACAAGC | 1066 | AcAAcccAuccucAcAAGcdTsdT | sense |
| 1570-1589 | 1067 | GCUUGUGAGGAUGGGUUGU | 1068 | GCUUGUGAGGAUGGGUUGUdTsdT | antis |
| 1589-1608 | 1069 | UUUAACUGAAGCUCAGACU | 1070 | uuuAAcuGAAGcucAGAcudTsdT | sense |
| 1589-1608 | 1071 | AGUCUGAGCUUCAGUUAAA | 1072 | AGUCUGAGCUUcAGUuAAAdTsdT | antis |
| 1609-1628 | 1073 | GCCAAGAUUGGCAGCCAUC | 1074 | GccAAGAuuGGcAGCcAucdTsdT | sense |
| 1609-1628 | 1075 | GAUGGCUGCCAAUCUUGGC | 1076 | GAUGGCUGCcAAUCUUGGCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1613-1632 | 1077 | AGAUUGGCAGCCAUCUGAU | 1078 | AGAuuGGcAGccAucuGAudTsdT | sense |
| 1613-1632 | 1079 | AUCAGAUGGCUGCCAAUCU | 1080 | AUcAGAUGGCUGCcAAUCUdTsdT | antis |
| 1615-1634 | 1081 | AUUGGCAGCCAUCUGAUGC | 1082 | AuuGGcAGccAucuGAuGcdTsdT | sense |
| 1615-1634 | 1083 | GCAUCAGAUGGCUGCCAAU | 1084 | GcAUcAGAUGGCUGCcAAUdTsdT | antis |
| 1809-1828 | 1085 | UCCCUCAGCAGCCUAACCU | 1086 | ucccucAGcAGccuAAccudTsdT | sense |
| 1809-1828 | 1087 | AGGUUAGGCUGCUGAGGGA | 1088 | AGGUuAGGCUGCUGAGGGAdTsdT | antis |
| 1844-1863 | 1089 | AAAGAGGAUUUUAACUGUU | 1090 | AAAGAGGAuuuuAAcuGuudTsdT | sense |
| 1844-1863 | 1091 | AACAGUUAAAAUCCUCUUU | 1092 | AAcAGUuAAAAUCCUCUUUdTsdT | antis |
| 1847-1866 | 1093 | GAGGAUUUUAACUGUUUGU | 1094 | GAGGAuuuuAAcuGuuuGudTsdT | sense |
| 1847-1866 | 1095 | ACAAACAGUUAAAAUCCUC | 1096 | AcAAAcAGUuAAAAUCCUCdTsdT | antis |
| 1853-1872 | 1097 | UUUAACUGUUUGUAGGGGA | 1098 | uuuAAcuGuuuGuAGGGGAdTsdT | sense |
| 1853-1872 | 1099 | UCCCCUACAAACAGUUAAA | 1100 | UCCCCuAcAAAcAGUuAAAdTsdT | antis |
| 1857-1876 | 1101 | ACUGUUUGUAGGGGAGGGG | 1102 | AcuGuuuGuAGGGGAGGGGdTsdT | sense |
| 1857-1876 | 1103 | CCCCUCCCCUACAAACAGU | 1104 | CCCCUCCCCuAcAAAcAGUdTsdT | antis |
| 1896-1915 | 1105 | UGGGGGUGUGAGGACCUUC | 1106 | uGGGGGuGuGAGGAccuucdTsdT | sense |
| 1896-1915 | 1107 | GAAGGUCCUCACACCCCCA | 1108 | GAAGGUCCUcAcACCCCcAdTsdT | antis |
| 1936-1955 | 1109 | UCCCCCAGGCUACCACUCC | 1110 | ucccccAGGcuAccAcuccdTsdT | sense |
| 1936-1955 | 1111 | GGAGUGGUAGCCUGGGGGA | 1112 | GGAGUGGuAGCCUGGGGGAdTsdT | antis |
| 1967-1986 | 1113 | CUCUCCCAGGUCCCUUGUA | 1114 | cucucccAGGucccuuGuAdTsdT | sense |
| 1967-1986 | 1115 | UACAAGGGACCUGGGAGAG | 1116 | uAcAAGGGACCUGGGAGAGdTsdT | antis |
| 1997-2016 | 1117 | CCCAGCCCAUCUCUCGUCU | 1118 | cccAGcccAucucucGucudTsdT | sense |
| 1997-2016 | 1119 | AGACGAGAGAUGGGCUGGG | 1120 | AGACGAGAGAUGGGCUGGGdTsdT | antis |
| 2001-2020 | 1121 | GCCCAUCUCUCGUCUUCCC | 1122 | GcccAucucucGucuucccdTsdT | sense |
| 2001-2020 | 1123 | GGGAAGACGAGAGAUGGGC | 1124 | GGGAAGACGAGAGAUGGGCdTsdT | antis |
| 2074-2093 | 1125 | GUCAAUUCACACCAUUCAA | 1126 | GucAAuucAcAccAuucAAdTsdT | sense |
| 2074-2093 | 1127 | UUGAAUGGUGUGAAUUGAC | 1128 | UUGAAUGGUGUGAAUUGACdTsdT | antis |
| 2093-2112 | 1129 | CUUGCCCCCCCAGCUGUA | 1130 | cuuGcccccccAGcuGuAdTsdT | sense |
| 2093-2112 | 1131 | UACAGCUGGGGGGGCAAG | 1132 | uAcAGCUGGGGGGGGcAAGdTsdT | antis |
| 2164-2183 | 1133 | GAGGGGAGUAGAGAGAGUC | 1134 | GAGGGGAGuAGAGAGAGucdTsdT | sense |
| 2164-2183 | 1135 | GACUCUCUCUACUCCCCUC | 1136 | GACUCUCUCuACUCCCCUCdTsdT | antis |
| 2168-2187 | 1137 | GGAGUAGAGAGAGUCCCUG | 1138 | GGAGuAGAGAGAGucccuGdTsdT | sense |
| 2168-2187 | 1139 | CAGGGACUCUCUCUACUCC | 1140 | cAGGGACUCUCUCuACUCCdTsdT | antis |
| 2185-2204 | 1141 | UGGUGUCUUAGUUUCCACA | 1142 | uGGuGucuuAGuuuccAcAdTsdT | sense |
| 2185-2204 | 1143 | UGUGGAAACUAAGACACCA | 1144 | UGUGGAAACuAAGAcACcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2191-2210 | 1145 | CUUAGUUUCCACAGUAAGG | 1146 | cuuAGuuuccAcAGuAAGGdTsdT | sense |
| 2191-2210 | 1147 | CCUUACUGUGGAAACUAAG | 1148 | CCUuACUGUGGAAACuAAGdTsdT | antis |
| 2202-2221 | 1149 | CAGUAAGGUUUGCCUGUGU | 1150 | cAGuAAGGuuuGccuGuGudTsdT | sense |
| 2202-2221 | 1151 | ACACAGGCAAACCUUACUG | 1152 | AcAcAGGcAAACCUuACUGdTsdT | antis |
| 2242-2261 | 1153 | UAUUGGCAUGAAACCCUUA | 1154 | uAuuGGcAuGAAAcccuuAdTsdT | sense |
| 2242-2261 | 1155 | UAAGGGUUUCAUGCCAAUA | 1156 | uAAGGGUUUcAUGCcAAuAdTsdT | antis |
| 388-407 | 1157 | GGGGUGGCCCCAGCGGCAG | 1158 | GGGGuGGccccAGcGGcAGdTsdT | sense |
| 388-407 | 1159 | CUGCCGCUGGGGCCACCCC | 1160 | CUGCCGCUGGGGCcACCCCdTsdT | antis |
| 425-444 | 1161 | UGGCCCCGGCGCGGGCACU | 1162 | uGGccccGGcGcGGGcAcudTsdT | sense |
| 425-444 | 1163 | AGUGCCCGCGCCGGGGCCA | 1164 | AGUGCCCGCGCCGGGGCcAdTsdT | antis |
| 2163-2182 | 1165 | GGAGGGGAGUAGAGAGAGU | 1166 | GGAGGGGAGuAGAGAGAGudTsdT | sense |
| 2163-2182 | 1167 | ACUCUCUCUACUCCCCUCC | 1168 | ACUCUCUCuACUCCCCUCCdTsdT | antis |
| 3-22 | 1169 | GGUGACAACGAAGCCGACG | 1170 | GGuGAcAAcGAAGccGAcGdTsdT | sense |
| 3-22 | 1171 | CGUCGGCUUCGUUGUCACC | 1172 | CGUCGGCUUCGUUGUcACCdTsdT | antis |
| 12-31 | 1173 | GAAGCCGACGGCAGAGGGA | 1174 | GAAGccGAcGGcAGAGGGAdTsdT | sense |
| 12-31 | 1175 | UCCCUCUGCCGUCGGCUUC | 1176 | UCCCUCUGCCGUCGGCUUCdTsdT | antis |
| 72-91 | 1177 | GCCGGAGCCCGAACGGCGC | 1178 | GccGGAGcccGAAcGGcGcdTsdT | sense |
| 72-91 | 1179 | GCGCCGUUCGGGCUCCGGC | 1180 | GCGCCGUUCGGGCUCCGGCdTsdT | antis |
| 90-109 | 1181 | CGGCCUGGAAGAGGCCGGA | 1182 | cGGccuGGAAGAGGccGGAdTsdT | sense |
| 90-109 | 1183 | UCCGGCCUCUUCCAGGCCG | 1184 | UCCGGCCUCUUCcAGGCCGdTsdT | antis |
| 316-335 | 1185 | GCCCAGGAGGCACUGGCGG | 1186 | GcccAGGAGGcAcuGGcGGdTsdT | sense |
| 316-335 | 1187 | CCGCCAGUGCCUCCUGGGC | 1188 | CCGCcAGUGCCUCCUGGGCdTsdT | antis |
| 335-354 | 1189 | CGGGAAAGCGUCAGUCGGG | 1190 | cGGGAAAGcGucAGucGGGdTsdT | sense |
| 335-354 | 1191 | CCCGACUGACGCUUUCCCG | 1192 | CCCGACUGACGCUUUCCCGdTsdT | antis |
| 466-485 | 1193 | AGCUGGGCCGUGACAGCGG | 1194 | AGcuGGGccGuGAcAGcGGdTsdT | sense |
| 466-485 | 1195 | CCGCUGUCACGGCCCAGCU | 1196 | CCGCUGUcACGGCCcAGCUdTsdT | antis |
| 489-508 | 1197 | GUGACCACAGUGGUAGCCA | 1198 | GuGAccAcAGuGGuAGccAdTsdT | sense |
| 489-508 | 1199 | UGGCUACCACUGUGGUCAC | 1200 | UGGCuACcACUGUGGUcACdTsdT | antis |
| 708-727 | 1201 | GUGAGGCUGCGGUACUUUU | 1202 | GuGAGGcuGcGGuAcuuuudTsdT | sense |
| 708-727 | 1203 | AAAAGUACCGCAGCCUCAC | 1204 | AAAAGuACCGcAGCCUcACdTsdT | antis |
| 1098-1117 | 1205 | GUGUGGUCGGCUGGCUGUG | 1206 | GuGuGGucGGcuGGcuGuGdTsdT | sense |
| 1098-1117 | 1207 | CACAGCCAGCCGACCACAC | 1208 | cAcAGCcAGCCGACcAcACdTsdT | antis |
| 1117-1136 | 1209 | UACUUGCUGAGCUACUUCU | 1210 | uAcuuGcuGAGcuAcuucudTsdT | sense |
| 1117-1136 | 1211 | AGAAGUAGCUCAGCAAGUA | 1212 | AGAAGuAGCUcAGcAAGuAdTsdT | antis |
| 1305-1324 | 1213 | AAGACACCACCUGAGGCCA | 1214 | AAGAcAccAccuGAGGccAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1305-1324 | 1215 | UGGCCUCAGGUGGUGUCUU | 1216 | UGGCCUcAGGUGGUGUCUUdTsdT | antis |
| 1341-1360 | 1217 | CUACUGGAGUACACGCCAU | 1218 | cuAcuGGAGuAcAcGccAudTsdT | sense |
| 1341-1360 | 1219 | AUGGCGUGUACUCCAGUAG | 1220 | AUGGCGUGuACUCcAGuAGdTsdT | antis |
| 1345-1364 | 1221 | UGGAGUACACGCCAUCCUC | 1222 | uGGAGuAcAcGccAuccucdTsdT | sense |
| 1345-1364 | 1223 | GAGGAUGGCGUGUACUCCA | 1224 | GAGGAUGGCGUGuACUCcAdTsdT | antis |
| 1811-1830 | 1225 | CCUCAGCAGCCUAACCUCU | 1226 | ccucAGcAGccuAAccucudTsdT | sense |
| 1811-1830 | 1227 | AGAGGUUAGGCUGCUGAGG | 1228 | AGAGGUuAGGCUGCUGAGGdTsdT | antis |
| 1850-1869 | 1229 | GAUUUUAACUGUUUGUAGG | 1230 | GAuuuuAAcuGuuuGuAGGdTsdT | sense |
| 1850-1869 | 1231 | CCUACAAACAGUUAAAAUC | 1232 | CCuAcAAAcAGUuAAAAUCdTsdT | antis |
| 1969-1988 | 1233 | CUCCCAGGUCCCUUGUAAA | 1234 | cucccAGGucccuuGuAAAdTsdT | sense |
| 1969-1988 | 1235 | UUUACAAGGGACCUGGGAG | 1236 | UUuAcAAGGGACCUGGGAGdTsdT | antis |
| 2162-2181 | 1237 | AGGAGGGGAGUAGAGAGAG | 1238 | AGGAGGGGAGuAGAGAGAGdTsdT | sense |
| 2162-2181 | 1239 | CUCUCUCUACUCCCCUCCU | 1240 | CUCUCUCuACUCCCCUCCUdTsdT | antis |
| 2195-2214 | 1241 | GUUUCCACAGUAAGGUUUG | 1242 | GuuuccAcAGuAAGGuuuGdTsdT | sense |
| 2195-2214 | 1243 | CAAACCUUACUGUGGAAAC | 1244 | cAAACCUuACUGUGGAAACdTsdT | antis |
| 1239-1258 | 1245 | AACUAUACGGAGUUCAAGU | 1246 | AAcuAuAcGGAGuucAAGudTsdT | sense |
| 1239-1258 | 1247 | ACUUGAACUCCGUAUAGUU | 1248 | ACUUGAACUCCGuAuAGUUdTsdT | antis |
| 1240-1259 | 1249 | ACUAUACGGAGUUCAAGUU | 1250 | AcuAuAcGGAGuucAAGuudTsdT | sense |
| 1240-1259 | 1251 | AACUUGAACUCCGUAUAGU | 1252 | AACUUGAACUCCGuAuAGUdTsdT | antis |
| 80-99 | 1253 | CCGAACGGCGCGGCCUGGA | 1254 | ccGAAcGGcGcGGccuGGAdTsdT | sense |
| 80-99 | 1255 | UCCAGGCCGCGCCGUUCGG | 1256 | UCcAGGCCGCGCCGUUCGGdTsdT | antis |
| 745-764 | 1257 | AGAAGGACGAGCUGUAUUU | 1258 | AGAAGGAcGAGcuGuAuuudTsdT | sense |
| 745-764 | 1259 | AAAUACAGCUCGUCCUUCU | 1260 | AAAuAcAGCUCGUCCUUCUdTsdT | antis |
| 1078-1097 | 1261 | AUUACACCUCGUCCAUCGA | 1262 | AuuAcAccucGuccAucGAdTsdT | sense |
| 1078-1097 | 1263 | UCGAUGGACGAGGUGUAAU | 1264 | UCGAUGGACGAGGUGuAAUdTsdT | antis |
| 2071-2090 | 1265 | AACGUCAAUUCACACCAUU | 1266 | AAcGucAAuucAcAccAuudTsdT | sense |
| 2071-2090 | 1267 | AAUGGUGUGAAUUGACGUU | 1268 | AAUGGUGUGAAUUGACGUUdTsdT | antis |
| 15-34 | 1269 | GCCGACGGCAGAGGGACUU | 1270 | GccGAcGGcAGAGGGAcuudTsdT | sense |
| 15-34 | 1271 | AAGUCCCUCUGCCGUCGGC | 1272 | AAGUCCCUCUGCCGUCGGCdTsdT | antis |
| 77-96 | 1273 | AGCCCGAACGGCGCGGCCU | 1274 | AGcccGAAcGGcGcGGccudTsdT | sense |
| 77-96 | 1275 | AGGCCGCGCCGUUCGGGCU | 1276 | AGGCCGCGCCGUUCGGGCUdTsdT | antis |
| 182-201 | 1277 | GCUCGGCGCCAUGAGCGGC | 1278 | GcucGGcGccAuGAGcGGcdTsdT | sense |
| 182-201 | 1279 | GCCGCUCAUGGCGCCGAGC | 1280 | GCCGCUcAUGGCGCCGAGCdTsdT | antis |
| 659-678 | 1281 | CAAGAACCGAGAACUGCAG | 1282 | cAAGAAccGAGAAcuGcAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 659-678 | 1283 | CUGCAGUUCUCGGUUCUUG | 1284 | CUGcAGUUCUCGGUUCUUGdTsdT | antis |
| 788-807 | 1285 | CGAGACGGUGUACCGAGUG | 1286 | cGAGAcGGuGuAccGAGuGdTsdT | sense |
| 788-807 | 1287 | CACUCGGUACACCGUCUCG | 1288 | cACUCGGuAcACCGUCUCGdTsdT | antis |
| 1002-1021 | 1289 | GUUCGGGGGAGCCCAAUG | 1290 | GuucGGGGGAGcccAAuGdTsdT | sense |
| 1002-1021 | 1291 | CAUUGGGCUCCCCCCGAAC | 1292 | cAUUGGGCUCCCCCCGAACdTsdT | antis |
| 1333-1352 | 1293 | GCUCUAGCCUACUGGAGUA | 1294 | GcucuAGccuAcuGGAGuAdTsdT | sense |
| 1333-1352 | 1295 | UACUCCAGUAGGCUAGAGC | 1296 | uACUCcAGuAGGCuAGAGCdTsdT | antis |
| 1435-1454 | 1297 | CCAACGACCGCCCGCUUCC | 1298 | ccAAcGAccGcccGcuuccdTsdT | sense |
| 1435-1454 | 1299 | GGAAGCGGGCGGUCGUUGG | 1300 | GGAAGCGGGCGGUCGUUGGdTsdT | antis |
| 2246-2265 | 1301 | GGCAUGAAACCCUUAAAAA | 1302 | GGcAuGAAAcccuuAAAAAdTsdT | sense |
| 2246-2265 | 1303 | UUUUUAAGGGUUUCAUGCC | 1304 | UUUUuAAGGGUUUcAUGCCdTsdT | antis |
| 14-33 | 1305 | AGCCGACGGCAGAGGGACU | 1306 | AGccGAcGGcAGAGGGAcudTsdT | sense |
| 14-33 | 1307 | AGUCCCUCUGCCGUCGGCU | 1308 | AGUCCCUCUGCCGUCGGCUdTsdT | antis |
| 17-36 | 1309 | CGACGGCAGAGGGACUUCA | 1310 | cGAcGGcAGAGGGAcuucAdTsdT | sense |
| 17-36 | 1311 | UGAAGUCCCUCUGCCGUCG | 1312 | UGAAGUCCCUCUGCCGUCGdTsdT | antis |
| 18-37 | 1313 | GACGGCAGAGGGACUUCAU | 1314 | GAcGGcAGAGGGAcuucAudTsdT | sense |
| 18-37 | 1315 | AUGAAGUCCCUCUGCCGUC | 1316 | AUGAAGUCCCUCUGCCGUCdTsdT | antis |
| 78-97 | 1317 | GCCCGAACGGCGCGGCCUG | 1318 | GcccGAAcGGcGcGGccuGdTsdT | sense |
| 78-97 | 1319 | CAGGCCGCGCCGUUCGGGC | 1320 | cAGGCCGCGCCGUUCGGGCdTsdT | antis |
| 81-100 | 1321 | CGAACGGCGCGGCCUGGAA | 1322 | cGAAcGGcGcGGccuGGAAdTsdT | sense |
| 81-100 | 1323 | UUCCAGGCCGCGCCGUUCG | 1324 | UUCcAGGCCGCGCCGUUCGdTsdT | antis |
| 83-102 | 1325 | AACGGCGCGGCCUGGAAGA | 1326 | AAcGGcGcGGccuGGAAGAdTsdT | sense |
| 83-102 | 1327 | UCUUCCAGGCCGCGCCGUU | 1328 | UCUUCcAGGCCGCGCCGUUdTsdT | antis |
| 87-106 | 1329 | GCGCGGCCUGGAAGAGGCC | 1330 | GcGcGGccuGGAAGAGGccdTsdT | sense |
| 87-106 | 1331 | GGCCUCUUCCAGGCCGCGC | 1332 | GGCCUCUUCcAGGCCGCGCdTsdT | antis |
| 181-200 | 1333 | CGCUCGGCGCCAUGAGCGG | 1334 | cGcucGGcGccAuGAGcGGdTsdT | sense |
| 181-200 | 1335 | CCGCUCAUGGCGCCGAGCG | 1336 | CCGCUcAUGGCGCCGAGCGdTsdT | antis |
| 183-202 | 1337 | CUCGGCGCCAUGAGCGGCG | 1338 | cucGGcGccAuGAGcGGcGdTsdT | sense |
| 183-202 | 1339 | CGCCGCUCAUGGCGCCGAG | 1340 | CGCCGCUcAUGGCGCCGAGdTsdT | antis |
| 189-208 | 1341 | GCCAUGAGCGGCGGCGGGC | 1342 | GccAuGAGcGGcGGcGGGcdTsdT | sense |
| 189-208 | 1343 | GCCCGCCGCCGCUCAUGGC | 1344 | GCCCGCCGCCGCUcAUGGCdTsdT | antis |
| 191-210 | 1345 | CAUGAGCGGCGGCGGGCCU | 1346 | cAuGAGcGGcGGcGGGccudTsdT | sense |
| 191-210 | 1347 | AGGCCCGCCGCCGCUCAUG | 1348 | AGGCCCGCCGCCGCUcAUGdTsdT | antis |
| 254-273 | 1349 | GUUCGCGGAGCCAGGAGGC | 1350 | GuucGcGGAGccAGGAGGcdTsdT | sense |
| 254-273 | 1351 | GCCUCCUGGCUCCGCGAAC | 1352 | GCCUCCUGGCUCCGCGAACdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 255-274 | 1353 | UUCGCGGAGCCAGGAGGCG | 1354 | uucGcGGAGccAGGAGGcGdTsdT | sense |
| 255-274 | 1355 | CGCCUCCUGGCUCCGCGAA | 1356 | CGCCUCCUGGCUCCGCGAAdTsdT | antis |
| 431-450 | 1357 | CGGCGCGGGCACUAGCUUC | 1358 | cGGcGcGGGcAcuAGcuucdTsdT | sense |
| 431-450 | 1359 | GAAGCUAGUGCCCGCGCCG | 1360 | GAAGCuAGUGCCCGCGCCGdTsdT | antis |
| 433-452 | 1361 | GCGCGGGCACUAGCUUCCC | 1362 | GcGcGGGcAcuAGcuucccdTsdT | sense |
| 433-452 | 1363 | GGGAAGCUAGUGCCCGCGC | 1364 | GGGAAGCuAGUGCCCGCGCdTsdT | antis |
| 441-460 | 1365 | ACUAGCUUCCCGCCGCCGG | 1366 | AcuAGcuucccGccGccGGdTsdT | sense |
| 441-460 | 1367 | CCGGCGGCGGGAAGCUAGU | 1368 | CCGGCGGCGGGAAGCuAGUdTsdT | antis |
| 442-461 | 1369 | CUAGCUUCCCGCCGCCGGG | 1370 | cuAGcuucccGccGccGGGdTsdT | sense |
| 442-461 | 1371 | CCCGGCGGCGGGAAGCUAG | 1372 | CCCGGCGGCGGGAAGCuAGdTsdT | antis |
| 446-465 | 1373 | CUUCCCGCCGCCGGGAGUG | 1374 | cuucccGccGccGGGAGuGdTsdT | sense |
| 446-465 | 1375 | CACUCCCGGCGGCGGGAAG | 1376 | cACUCCCGGCGGCGGGAAGdTsdT | antis |
| 473-492 | 1377 | CCGUGACAGCGGGAAGGUG | 1378 | ccGuGAcAGcGGGAAGGuGdTsdT | sense |
| 473-492 | 1379 | CACCUUCCCGCUGUCACGG | 1380 | cACCUUCCCGCUGUcACGGdTsdT | antis |
| 532-551 | 1381 | CCCAAGAAGUGGCUUACAC | 1382 | cccAAGAAGuGGcuuAcAcdTsdT | sense |
| 532-551 | 1383 | GUGUAAGCCACUUCUUGGG | 1384 | GUGuAAGCcACUUCUUGGGdTsdT | antis |
| 580-599 | 1385 | UCGGAGUAGUAUACCAGGC | 1386 | ucGGAGuAGuAuAccAGGcdTsdT | sense |
| 580-599 | 1387 | GCCUGGUAUACUACUCCGA | 1388 | GCCUGGuAuACuACUCCGAdTsdT | antis |
| 589-608 | 1389 | UAUACCAGGCACGGCUGGC | 1390 | uAuAccAGGcAcGGcuGGcdTsdT | sense |
| 589-608 | 1391 | GCCAGCCGUGCCUGGUAUA | 1392 | GCcAGCCGUGCCUGGuAuAdTsdT | antis |
| 598-617 | 1393 | CACGGCUGGCAGAGACGAG | 1394 | cAcGGcuGGcAGAGAcGAGdTsdT | sense |
| 598-617 | 1395 | CUCGUCUCUGCCAGCCGUG | 1396 | CUCGUCUCUGCcAGCCGUGdTsdT | antis |
| 837-856 | 1397 | ACCCCUAUCAUCUACAUCA | 1398 | AccccuAucAucuAcAucAdTsdT | sense |
| 837-856 | 1399 | UGAUGUAGAUGAUAGGGGU | 1400 | UGAUGuAGAUGAuAGGGGUdTsdT | antis |
| 838-857 | 1401 | CCCCUAUCAUCUACAUCAA | 1402 | cccuAucAucuAcAucAAdTsdT | sense |
| 838-857 | 1403 | UUGAUGUAGAUGAUAGGGG | 1404 | UUGAUGuAGAUGAuAGGGGdTsdT | antis |
| 839-858 | 1405 | CCCUAUCAUCUACAUCAAG | 1406 | cccuAucAucuAcAucAAGdTsdT | sense |
| 839-858 | 1407 | CUUGAUGUAGAUGAUAGGG | 1408 | CUUGAUGuAGAUGAuAGGGdTsdT | antis |
| 922-941 | 1409 | ACAUCAAGCCCCAGAAUUU | 1410 | AcAucAAGccccAGAAuuudTsdT | sense |
| 922-941 | 1411 | AAAUUCUGGGGCUUGAUGU | 1412 | AAAUUCUGGGGCUUGAUGUdTsdT | antis |
| 923-942 | 1413 | CAUCAAGCCCCAGAAUUUG | 1414 | cAucAAGccccAGAAuuuGdTsdT | sense |
| 923-942 | 1415 | CAAAUUCUGGGGCUUGAUG | 1416 | cAAAUUCUGGGGCUUGAUGdTsdT | antis |
| 1012-1031 | 1417 | AGCCCAAUGUGUCCUACAU | 1418 | AGcccAAuGuGuccuAcAudTsdT | sense |
| 1012-1031 | 1419 | AUGUAGGACACAUUGGGCU | 1420 | AUGuAGGAcAcAUUGGGCUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1014-1033 | 1421 | CCCAAUGUGUCCUACAUCU | 1422 | cccAAuGuGuccuAcAucudTsdT | sense |
| 1014-1033 | 1423 | AGAUGUAGGACACAUUGGG | 1424 | AGAUGuAGGAcAcAUUGGGdTsdT | antis |
| 1046-1065 | 1425 | CCGUGCUCCAGAACUCAUC | 1426 | ccGuGcuccAGAAcucAucdTsdT | sense |
| 1046-1065 | 1427 | GAUGAGUUCUGGAGCACGG | 1428 | GAUGAGUUCUGGAGcACGGdTsdT | antis |
| 1056-1075 | 1429 | GAACUCAUCUUUGGAGCCA | 1430 | GAAcucAucuuuGGAGccAdTsdT | sense |
| 1056-1075 | 1431 | UGGCUCCAAAGAUGAGUUC | 1432 | UGGCUCcAAAGAUGAGUUCdTsdT | antis |
| 1088-1107 | 1433 | GUCCAUCGAUGUGUGGUCG | 1434 | GuccAucGAuGuGuGGucGdTsdT | sense |
| 1088-1107 | 1435 | CGACCACACAUCGAUGGAC | 1436 | CGACcAcAcAUCGAUGGACdTsdT | antis |
| 1123-1142 | 1437 | CUGAGCUACUUCUCGGCCA | 1438 | cuGAGcuAcuucucGGccAdTsdT | sense |
| 1123-1142 | 1439 | UGGCCGAGAAGUAGCUCAG | 1440 | UGGCCGAGAAGuAGCUcAGdTsdT | antis |
| 1232-1251 | 1441 | GAACCCUAACUAUACGGAG | 1442 | GAAcccuAAcuAuAcGGAGdTsdT | sense |
| 1232-1251 | 1443 | CUCCGUAUAGUUAGGGUUC | 1444 | CUCCGuAuAGUuAGGGUUCdTsdT | antis |
| 1287-1306 | 1445 | AAGGUGUUCAAAUCUUCAA | 1446 | AAGGuGuucAAAucuucAAdTsdT | sense |
| 1287-1306 | 1447 | UUGAAGAUUUGAACACCUU | 1448 | UUGAAGAUUUGAAcACCUUdTsdT | antis |
| 1319-1338 | 1449 | GGCCAUUGCACUCUGCUCU | 1450 | GGccAuuGcAcucuGcucudTsdT | sense |
| 1319-1338 | 1451 | AGAGCAGAGUGCAAUGGCC | 1452 | AGAGcAGAGUGcAAUGGCCdTsdT | antis |
| 1349-1368 | 1453 | GUACACGCCAUCCUCAAGG | 1454 | GuAcAcGccAuccucAAGGdTsdT | sense |
| 1349-1368 | 1455 | CCUUGAGGAUGGCGUGUAC | 1456 | CCUUGAGGAUGGCGUGuACdTsdT | antis |
| 1409-1428 | 1457 | ACUGCGGAGACUCGGAGCC | 1458 | AcuGcGGAGAcucGGAGccdTsdT | sense |
| 1409-1428 | 1459 | GGCUCCGAGUCUCCGCAGU | 1460 | GGCUCCGAGUCUCCGcAGUdTsdT | antis |
| 1410-1429 | 1461 | CUGCGGAGACUCGGAGCCC | 1462 | cuGcGGAGAcucGGAGcccdTsdT | sense |
| 1410-1429 | 1463 | GGGCUCCGAGUCUCCGCAG | 1464 | GGGCUCCGAGUCUCCGcAGdTsdT | antis |
| 1448-1467 | 1465 | GCUUCCCCCCUGUUCAAC | 1466 | GcuuccccccuGuucAAcdTsdT | sense |
| 1448-1467 | 1467 | GUUGAACAGGGGGGAAGC | 1468 | GUUGAAcAGGGGGGAAGCdTsdT | antis |
| 1449-1468 | 1469 | CUUCCCCCCUGUUCAACU | 1470 | cuuccccccuGuucAAcudTsdT | sense |
| 1449-1468 | 1471 | AGUUGAACAGGGGGGAAG | 1472 | AGUUGAAcAGGGGGGAAGdTsdT | antis |
| 1450-1469 | 1473 | UUCCCCCCUGUUCAACUU | 1474 | uuccccccuGuucAAcuudTsdT | sense |
| 1450-1469 | 1475 | AAGUUGAACAGGGGGGAA | 1476 | AAGUUGAAcAGGGGGGAAdTsdT | antis |
| 1567-1586 | 1477 | CCUACAACCCAUCCUCACA | 1478 | ccuAcAAcccAuccucAcAdTsdT | sense |
| 1567-1586 | 1479 | UGUGAGGAUGGGUUGUAGG | 1480 | UGUGAGGAUGGGUUGuAGGdTsdT | antis |
| 1583-1602 | 1481 | ACAAGCUUUAACUGAAGCU | 1482 | AcAAGcuuuAAcuGAAGcudTsdT | sense |
| 1583-1602 | 1483 | AGCUUCAGUUAAAGCUUGU | 1484 | AGCUUcAGUuAAAGCUUGUdTsdT | antis |
| 1596-1615 | 1485 | GAAGCUCAGACUGGCCAAG | 1486 | GAAGcucAGAcuGGccAAGdTsdT | sense |
| 1596-1615 | 1487 | CUUGGCCAGUCUGAGCUUC | 1488 | CUUGGCcAGUCUGAGCUUCdTsdT | antis |
| 1608-1627 | 1489 | GGCCAAGAUUGGCAGCCAU | 1490 | GGccAAGAuuGGcAGccAudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1608-1627 | 1491 | AUGGCUGCCAAUCUUGGCC | 1492 | AUGGCUGCcAAUCUUGGCCdTsdT | antis |
| 1638-1657 | 1493 | ACUGCUACCCUCGCUAGCU | 1494 | AcuGcuAcccucGcuAGcudTsdT | sense |
| 1638-1657 | 1495 | AGCUAGCGAGGGUAGCAGU | 1496 | AGCuAGCGAGGGuAGcAGUdTsdT | antis |
| 1854-1873 | 1497 | UUAACUGUUUGUAGGGGAG | 1498 | uuAAcuGuuuGuAGGGGAGdTsdT | sense |
| 1854-1873 | 1499 | CUCCCCUACAAACAGUUAA | 1500 | CUCCCCuAcAAAcAGUuAAdTsdT | antis |
| 1980-1999 | 1501 | CUUGUAAAUAGAACCAGCC | 1502 | cuuGuAAAuAGAAccAGccdTsdT | sense |
| 1980-1999 | 1503 | GGCUGGUUCUAUUUACAAG | 1504 | GGCUGGUUCuAUUuAcAAGdTsdT | antis |
| 2034-2053 | 1505 | GGGUGUAAAUAGAUUGUUA | 1506 | GGGuGuAAAuAGAuuGuuAdTsdT | sense |
| 2034-2053 | 1507 | UAACAAUCUAUUUACACCC | 1508 | uAAcAAUCuAUUuAcACCCdTsdT | antis |
| 2037-2056 | 1509 | UGUAAAUAGAUUGUUAUAA | 1510 | uGuAAAuAGAuuGuuAuAAdTsdT | sense |
| 2037-2056 | 1511 | UUAUAACAAUCUAUUUACA | 1512 | UuAuAAcAAUCuAUUuAcAdTsdT | antis |
| 2087-2106 | 1513 | AUUCAACUUGCCCCCCCCA | 1514 | AuucAAcuuGcccccccccAdTsdT | sense |
| 2087-2106 | 1515 | UGGGGGGGGCAAGUUGAAU | 1516 | UGGGGGGGGcAAGUUGAAUdTsdT | antis |
| 2088-2107 | 1517 | UUCAACUUGCCCCCCCCAG | 1518 | uucAAcuuGccccccccAGdTsdT | sense |
| 2088-2107 | 1519 | CUGGGGGGGGCAAGUUGAA | 1520 | CUGGGGGGGGcAAGUUGAAdTsdT | antis |
| 2171-2190 | 1521 | GUAGAGAGAGUCCCUGGUG | 1522 | GuAGAGAGAGucccuGuGdTsdT | sense |
| 2171-2190 | 1523 | CACCAGGGACUCUCUCUAC | 1524 | cACcAGGGACUCUCUCuACdTsdT | antis |
| 2212-2231 | 1525 | UGCCUGUGUACAGACCUCU | 1526 | uGccuGuGuAcAGAccucudTsdT | sense |
| 2212-2231 | 1527 | AGAGGUCUGUACACAGGCA | 1528 | AGAGGUCUGuAcAcAGGcAdTsdT | antis |
| 2221-2240 | 1529 | ACAGACCUCUGUUCAAUAA | 1530 | AcAGAccucuGuucAAuAAdTsdT | sense |
| 2221-2240 | 1531 | UUAUUGAACAGAGGUCUGU | 1532 | UuAUUGAAcAGAGGUCUGUdTsdT | antis |
| 190-209 | 1533 | CCAUGAGCGGCGGCGGGCC | 1534 | ccAuGAGcGGcGGcGGGccdTsdT | sense |
| 190-209 | 1535 | GGCCCGCCGCCGCUCAUGG | 1536 | GGCCCGCCGCCGCUcAUGGdTsdT | antis |
| 377-396 | 1537 | CUCGAGCUCCGGGGGUGGC | 1538 | cucGAGcuccGGGGGuGGcdTsdT | sense |
| 377-396 | 1539 | GCCACCCCGGAGCUCGAG | 1540 | GCcACCCCGGAGCUCGAGdTsdT | antis |
| 469-488 | 1541 | UGGGCCGUGACAGCGGGAA | 1542 | uGGGccGuGAcAGcGGGAAdTsdT | sense |
| 469-488 | 1543 | UUCCCGCUGUCACGGCCCA | 1544 | UUCCCGCUGUcACGGCCcAdTsdT | antis |
| 590-609 | 1545 | AUACCAGGCACGGCUGGCA | 1546 | AuAccAGGcAcGGcuGGcAdTsdT | sense |
| 590-609 | 1547 | UGCCAGCCGUGCCUGGUAU | 1548 | UGCcAGCCGUGCCUGGuAUdTsdT | antis |
| 658-677 | 1549 | UCAAGAACCGAGAACUGCA | 1550 | ucAAGAAccGAGAAcuGcAdTsdT | sense |
| 658-677 | 1551 | UGCAGUUCUCGGUUCUUGA | 1552 | UGcAGUUCUCGGUUCUUGAdTsdT | antis |
| 998-1017 | 1553 | GCUGGUUCGGGGGGAGCCC | 1554 | GcuGGuucGGGGGGAGcccdTsdT | sense |
| 998-1017 | 1555 | GGGCUCCCCCCGAACCAGC | 1556 | GGGCUCCCCCCGAAccAGCdTsdT | antis |
| 999-1018 | 1557 | CUGGUUCGGGGGGAGCCCA | 1558 | cuGGuucGGGGGGAGcccAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 999-1018 | 1559 | UGGGCUCCCCCCGAACCAG | 1560 | UGGGCUCCCCCCGAACcAGdTsdT | antis |
| 1025-1044 | 1561 | CUACAUCUGCUCUCGGUAC | 1562 | cuAcAucuGcucucGGuAcdTsdT | sense |
| 1025-1044 | 1563 | GUACCGAGAGCAGAUGUAG | 1564 | GuACCGAGAGcAGAUGuAGdTsdT | antis |
| 1327-1346 | 1565 | CACUCUGCUCUAGCCUACU | 1566 | cAcucuGcucuAGccuAcudTsdT | sense |
| 1327-1346 | 1567 | AGUAGGCUAGAGCAGAGUG | 1568 | AGuAGGCuAGAGcAGAGUGdTsdT | antis |
| 1417-1436 | 1569 | GACUCGGAGCCCAGCUCCC | 1570 | GAcucGGAGcccAGcucccdTsdT | sense |
| 1417-1436 | 1571 | GGGAGCUGGGCUCCGAGUC | 1572 | GGGAGCUGGGCUCCGAGUCdTsdT | antis |
| 1594-1613 | 1573 | CUGAAGCUCAGACUGGCCA | 1574 | cuGAAGcucAGAcuGGccAdTsdT | sense |
| 1594-1613 | 1575 | UGGCCAGUCUGAGCUUCAG | 1576 | UGGCcAGUCUGAGCUUcAGdTsdT | antis |
| 2213-2232 | 1577 | GCCUGUGUACAGACCUCUG | 1578 | GccuGuGuAcAGAccucuGdTsdT | sense |
| 2213-2232 | 1579 | CAGAGGUCUGUACACAGGC | 1580 | cAGAGGUCUGuAcAcAGGCdTsdT | antis |
| 1451-1470 | 1581 | UCCCCCCCUGUUCAACUUC | 1582 | uccccccuGuucAAcuucdTsdT | sense |
| 1451-1470 | 1583 | GAAGUUGAACAGGGGGGGA | 1584 | GAAGUUGAAcAGGGGGGGAdTsdT | antis |
| 1563-1582 | 1585 | ACUUCCUACAACCCAUCCU | 1586 | AcuuccuAcAAcccAuccudTsdT | sense |
| 1563-1582 | 1587 | AGGAUGGGUUGUAGGAAGU | 1588 | AGGAUGGGUUGuAGGAAGUdTsdT | antis |
| 1607-1626 | 1589 | UGGCCAAGAUUGGCAGCCA | 1590 | uGGccAAGAuuGGcAGccAdTsdT | sense |
| 1607-1626 | 1591 | UGGCUGCCAAUCUUGGCCA | 1592 | UGGCUGCcAAUCUUGGCcAdTsdT | antis |
| 1939-1958 | 1593 | CCCAGGCUACCACUCCUUC | 1594 | cccAGGcuAccAcuccuucdTsdT | sense |
| 1939-1958 | 1595 | GAAGGAGUGGUAGCCUGGG | 1596 | GAAGGAGUGGuAGCCUGGGdTsdT | antis |
| 74-93 | 1597 | CGGAGCCCGAACGGCGCGG | 1598 | cGGAGcccGAAcGGcGcGGdTsdT | sense |
| 74-93 | 1599 | CCGCGCCGUUCGGGCUCCG | 1600 | CCGCGCCGUUCGGGCUCCGdTsdT | antis |
| 75-94 | 1601 | GGAGCCCGAACGGCGCGGC | 1602 | GGAGcccGAAcGGcGcGGcdTsdT | sense |
| 75-94 | 1603 | GCCGCGCCGUUCGGGCUCC | 1604 | GCCGCGCCGUUCGGGCUCCdTsdT | antis |
| 85-104 | 1605 | CGGCGCGGCCUGGAAGAGG | 1606 | cGGcGcGGccuGGAAGAGGdTsdT | sense |
| 85-104 | 1607 | CCUCUUCCAGGCCGCGCCG | 1608 | CCUCUUCcAGGCCGCGCCGdTsdT | antis |
| 86-105 | 1609 | GGCGCGGCCUGGAAGAGGC | 1610 | GGcGcGGccuGGAAGAGGcdTsdT | sense |
| 86-105 | 1611 | GCCUCUUCCAGGCCGCGCC | 1612 | GCCUCUUCcAGGCCGCGCCdTsdT | antis |
| 203-222 | 1613 | CGGGCCUUCGGGAGGCGGC | 1614 | cGGGccuucGGGAGGcGGcdTsdT | sense |
| 203-222 | 1615 | GCCGCCUCCCGAAGGCCCG | 1616 | GCCGCCUCCCGAAGGCCCGdTsdT | antis |
| 206-225 | 1617 | GCCUUCGGGAGGCGGCCCU | 1618 | GccuucGGGAGGcGGcccudTsdT | sense |
| 206-225 | 1619 | AGGGCCGCCUCCCGAAGGC | 1620 | AGGGCCGCCUCCCGAAGGCdTsdT | antis |
| 208-227 | 1621 | CUUCGGGAGGCGGCCCUGG | 1622 | cuucGGGAGGcGGcccuGGdTsdT | sense |
| 208-227 | 1623 | CCAGGGCCGCCUCCCGAAG | 1624 | CcAGGGCCGCCUCCCGAAGdTsdT | antis |
| 245-264 | 1625 | GACCAGCUCGUUCGCGGAG | 1626 | GAccAGcucGuucGcGGAGdTsdT | sense |
| 245-264 | 1627 | CUCCGCGAACGAGCUGGUC | 1628 | CUCCGCGAACGAGCUGGUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 448-467 | 1629 | UCCCGCCGCCGGGAGUGAA | 1630 | ucccGccGccGGGAGuGAAdTsdT | sense |
| 448-467 | 1631 | UUCACUCCCGGCGGCGGGA | 1632 | UUcACUCCCGGCGGCGGGAdTsdT | antis |
| 452-471 | 1633 | GCCGCCGGGAGUGAAGCUG | 1634 | GccGccGGGAGuGAAGcuGdTsdT | sense |
| 452-471 | 1635 | CAGCUUCACUCCCGGCGGC | 1636 | cAGCUUcACUCCCGGCGGCdTsdT | antis |
| 453-472 | 1637 | CCGCCGGGAGUGAAGCUGG | 1638 | ccGccGGGAGuGAAGcuGGdTsdT | sense |
| 453-472 | 1639 | CCAGCUUCACUCCCGGCGG | 1640 | CcAGCUUcACUCCCGGCGGdTsdT | antis |
| 470-489 | 1641 | GGGCCGUGACAGCGGGAAG | 1642 | GGGccGuGAcAGcGGGAAGdTsdT | sense |
| 470-489 | 1643 | CUUCCCGCUGUCACGGCCC | 1644 | CUUCCCGCUGUcACGGCCCdTsdT | antis |
| 588-607 | 1645 | GUAUACCAGGCACGGCUGG | 1646 | GuAuAccAGGcAcGGcuGGdTsdT | sense |
| 588-607 | 1647 | CCAGCCGUGCCUGGUAUAC | 1648 | CcAGCCGUGCCUGGuAuACdTsdT | antis |
| 609-628 | 1649 | GAGACGAGGGAACUGGUGG | 1650 | GAGAcGAGGGAAcuGGuGGdTsdT | sense |
| 609-628 | 1651 | CCACCAGUUCCCUCGUCUC | 1652 | CcACcAGUUCCCUCGUCUCdTsdT | antis |
| 611-630 | 1653 | GACGAGGGAACUGGUGGCC | 1654 | GAcGAGGGAAcuGGuGGccdTsdT | sense |
| 611-630 | 1655 | GGCCACCAGUUCCCUCGUC | 1656 | GGCcACcAGUUCCCUCGUCdTsdT | antis |
| 649-668 | 1657 | ACAAAAGGUUCAAGAACCG | 1658 | AcAAAAGGuucAAGAAccGdTsdT | sense |
| 649-668 | 1659 | CGGUUCUUGAACCUUUUGU | 1660 | CGGUUCUUGAACCUUUUGUdTsdT | antis |
| 652-671 | 1661 | AAAGGUUCAAGAACCGAGA | 1662 | AAAGGuucAAGAAccGAGAdTsdT | sense |
| 652-671 | 1663 | UCUCGGUUCUUGAACCUUU | 1664 | UCUCGGUUCUUGAACCUUUdTsdT | antis |
| 653-672 | 1665 | AAGGUUCAAGAACCGAGAA | 1666 | AAGGuucAAGAAccGAGAAdTsdT | sense |
| 653-672 | 1667 | UUCUCGGUUCUUGAACCUU | 1668 | UUCUCGGUUCUUGAACCUUdTsdT | antis |
| 742-761 | 1669 | AGAAGAAGGACGAGCUGUA | 1670 | AGAAGAAGGAcGAGcuGuAdTsdT | sense |
| 742-761 | 1671 | UACAGCUCGUCCUUCUUCU | 1672 | uAcAGCUCGUCCUUCUUCUdTsdT | antis |
| 744-763 | 1673 | AAGAAGGACGAGCUGUAUU | 1674 | AAGAAGGAcGAGcuGuAuudTsdT | sense |
| 744-763 | 1675 | AAUACAGCUCGUCCUUCUU | 1676 | AAuAcAGCUCGUCCUUCUUdTsdT | antis |
| 790-809 | 1677 | AGACGGUGUACCGAGUGGC | 1678 | AGAcGGuGuAccGAGuGGcdTsdT | sense |
| 790-809 | 1679 | GCCACUCGGUACACCGUCU | 1680 | GCcACUCGGuAcACCGUCUdTsdT | antis |
| 840-859 | 1681 | CCUAUCAUCUACAUCAAGG | 1682 | ccuAucAucuAcAucAAGGdTsdT | sense |
| 840-859 | 1683 | CCUUGAUGUAGAUGAUAGG | 1684 | CCUUGAUGuAGAUGAuAGGdTsdT | antis |
| 882-901 | 1685 | AGCUUGGCCUACAUCCACU | 1686 | AGcuuGGccuAcAuccAcudTsdT | sense |
| 882-901 | 1687 | AGUGGAUGUAGGCCAAGCU | 1688 | AGUGGAUGuAGGCcAAGCUdTsdT | antis |
| 912-931 | 1689 | UGUCACCGUGACAUCAAGC | 1690 | uGucAccGuGAcAucAAGcdTsdT | sense |
| 912-931 | 1691 | GCUUGAUGUCACGGUGACA | 1692 | GCUUGAUGUcACGGUGAcAdTsdT | antis |
| 947-966 | 1693 | GGACCCUGACACUGCUGUC | 1694 | GGAcccuGAcAcuGcuGucdTsdT | sense |
| 947-966 | 1695 | GACAGCAGUGUCAGGGUCC | 1696 | GAcAGcAGUGUcAGGGUCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1009-1028 | 1697 | GGGAGCCCAAUGUGUCCUA | 1698 | GGGAGcccAAuGuGuccuAdTsdT | sense |
| 1009-1028 | 1699 | UAGGACACAUUGGGCUCCC | 1700 | uAGGAcAcAUUGGGCUCCCdTsdT | antis |
| 1017-1036 | 1701 | AAUGUGUCCUACAUCUGCU | 1702 | AAuGuGuccuAcAucuGcudTsdT | sense |
| 1017-1036 | 1703 | AGCAGAUGUAGGACACAUU | 1704 | AGcAGAUGuAGGAcAcAUUdTsdT | antis |
| 1113-1132 | 1705 | UGUGUACUUGCUGAGCUAC | 1706 | uGuGuAcuuGcuGAGcuAcdTsdT | sense |
| 1113-1132 | 1707 | GUAGCUCAGCAAGUACACA | 1708 | GuAGCUcAGcAAGuAcAcAdTsdT | antis |
| 1121-1140 | 1709 | UGCUGAGCUACUUCUCGGC | 1710 | uGcuGAGcuAcuucucGGcdTsdT | sense |
| 1121-1140 | 1711 | GCCGAGAAGUAGCUCAGCA | 1712 | GCCGAGAAGuAGCUcAGcAdTsdT | antis |
| 1268-1287 | 1713 | CAAAGCUCACCCUUGGACA | 1714 | cAAAGcucAcccuuGGAcAdTsdT | sense |
| 1268-1287 | 1715 | UGUCCAAGGGUGAGCUUUG | 1716 | UGUCcAAGGGUGAGCUUUGdTsdT | antis |
| 1290-1309 | 1717 | GUGUUCAAAUCUUCAAAGA | 1718 | GuGuucAAAucuucAAAGAdTsdT | sense |
| 1290-1309 | 1719 | UCUUUGAAGAUUUGAACAC | 1720 | UCUUUGAAGAUUUGAAcACdTsdT | antis |
| 1308-1327 | 1721 | ACACCACCUGAGGCCAUUG | 1722 | AcAccAccuGAGGccAuuGdTsdT | sense |
| 1308-1327 | 1723 | CAAUGGCCUCAGGUGGUGU | 1724 | cAAUGGCCUcAGGUGGUGUdTsdT | antis |
| 1312-1331 | 1725 | CACCUGAGGCCAUUGCACU | 1726 | cAccuGAGGccAuuGcAcudTsdT | sense |
| 1312-1331 | 1727 | AGUGCAAUGGCCUCAGGUG | 1728 | AGUGcAAUGGCCUcAGGUGdTsdT | antis |
| 1326-1345 | 1729 | GCACUCUGCUCUAGCCUAC | 1730 | GcAcucuGcucuAGccuAcdTsdT | sense |
| 1326-1345 | 1731 | GUAGGCUAGAGCAGAGUGC | 1732 | GuAGGCuAGAGcAGAGUGCdTsdT | antis |
| 1332-1351 | 1733 | UGCUCUAGCCUACUGGAGU | 1734 | uGcucuAGccuAcuGGAGudTsdT | sense |
| 1332-1351 | 1735 | ACUCCAGUAGGCUAGAGCA | 1736 | ACUCcAGuAGGCuAGAGcAdTsdT | antis |
| 1406-1425 | 1737 | UGAACUGCGGAGACUCGGA | 1738 | uGAAcuGcGGAGAcucGGAdTsdT | sense |
| 1406-1425 | 1739 | UCCGAGUCUCCGCAGUUCA | 1740 | UCCGAGUCUCCGcAGUUcAdTsdT | antis |
| 1407-1426 | 1741 | GAACUGCGGAGACUCGGAG | 1742 | GAAcuGcGGAGAcucGGAGdTsdT | sense |
| 1407-1426 | 1743 | CUCCGAGUCUCCGCAGUUC | 1744 | CUCCGAGUCUCCGcAGUUCdTsdT | antis |
| 1415-1434 | 1745 | GAGACUCGGAGCCCAGCUC | 1746 | GAGAcucGGAGcccAGcucdTsdT | sense |
| 1415-1434 | 1747 | GAGCUGGGCUCCGAGUCUC | 1748 | GAGCUGGGCUCCGAGUCUCdTsdT | antis |
| 1464-1483 | 1749 | AACUUCAGUCCUGGUGAAC | 1750 | AAcuucAGuccuGGuGAAcdTsdT | sense |
| 1464-1483 | 1751 | GUUCACCAGGACUGAAGUU | 1752 | GUUcAccAGGACUGAAGUUdTsdT | antis |
| 1465-1484 | 1753 | ACUUCAGUCCUGGUGAACU | 1754 | AcuucAGuccuGGuGAAcudTsdT | sense |
| 1465-1484 | 1755 | AGUUCACCAGGACUGAAGU | 1756 | AGUUcAccAGGACUGAAGUdTsdT | antis |
| 1479-1498 | 1757 | GAACUGUCCAUCCAACCAU | 1758 | GAAcuGuccAuccAAccAudTsdT | sense |
| 1479-1498 | 1759 | AUGGUUGGAUGGACAGUUC | 1760 | AUGGUUGGAUGGAcAGUUCdTsdT | antis |
| 1566-1585 | 1761 | UCCUACAACCCAUCCUCAC | 1762 | uccuAcAAcccAuccucAcdTsdT | sense |
| 1566-1585 | 1763 | GUGAGGAUGGGUUGUAGGA | 1764 | GUGAGGAUGGGUUGuAGGAdTsdT | antis |
| 1571-1590 | 1765 | CAACCCAUCCUCACAAGCU | 1766 | cAAcccAuccucAcAAGcudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1571-1590 | 1767 | AGCUUGUGAGGAUGGGUUG | 1768 | AGCUUGUGAGGAUGGGUUGdTsdT | antis |
| 1584-1603 | 1769 | CAAGCUUUAACUGAAGCUC | 1770 | cAAGcuuuAAcuGAAGcucdTsdT | sense |
| 1584-1603 | 1771 | GAGCUUCAGUUAAAGCUUG | 1772 | GAGCUUcAGUuAAAGCUUGdTsdT | antis |
| 1802-1821 | 1773 | CUAGGCCUCCCUCAGCAGC | 1774 | cuAGGccucccucAGcAGcdTsdT | sense |
| 1802-1821 | 1775 | GCUGCUGAGGGAGGCCUAG | 1776 | GCUGCUGAGGGAGGCCuAGdTsdT | antis |
| 1938-1957 | 1777 | CCCCAGGCUACCACUCCUU | 1778 | ccccAGGcuAccAcuccuudTsdT | sense |
| 1938-1957 | 1779 | AAGGAGUGGUAGCCUGGGG | 1780 | AAGGAGUGGuAGCCUGGGGdTsdT | antis |
| 1986-2005 | 1781 | AAUAGAACCAGCCCAGCCC | 1782 | AAuAGAAccAGcccAGcccdTsdT | sense |
| 1986-2005 | 1783 | GGGCUGGGCUGGUUCUAUU | 1784 | GGGCUGGGCUGGUUCuAUUdTsdT | antis |
| 1987-2006 | 1785 | AUAGAACCAGCCCAGCCCA | 1786 | AuAGAAccAGcccAGcccAdTsdT | sense |
| 1987-2006 | 1787 | UGGGCUGGGCUGGUUCUAU | 1788 | UGGGCUGGGCUGGUUCuAUdTsdT | antis |
| 2032-2051 | 1789 | CUGGGUGUAAAUAGAUUGU | 1790 | cuGGGuGuAAAuAGAuuGudTsdT | sense |
| 2032-2051 | 1791 | ACAAUCUAUUUACACCCAG | 1792 | AcAAUCuAUUuAcACCCAGdTsdT | antis |
| 2085-2104 | 1793 | CCAUUCAACUUGCCCCCCC | 1794 | ccAuucAAcuuGccccccdTsdT | sense |
| 2085-2104 | 1795 | GGGGGGGCAAGUUGAAUGG | 1796 | GGGGGGGcAAGUUGAAUGGdTsdT | antis |
| 2090-2109 | 1797 | CAACUUGCCCCCCCCAGCU | 1798 | cAAcuuGccccccccAGcudTsdT | sense |
| 2090-2109 | 1799 | AGCUGGGGGGGCAAGUUG | 1800 | AGCUGGGGGGGcAAGUUGdTsdT | antis |
| 2094-2113 | 1801 | UUGCCCCCCCCAGCUGUAC | 1802 | uuGccccccccAGcuGuAcdTsdT | sense |
| 2094-2113 | 1803 | GUACAGCUGGGGGGGGCAA | 1804 | GuAcAGCUGGGGGGGGcAAdTsdT | antis |
| 2101-2120 | 1805 | CCCCAGCUGUACCCCUUCU | 1806 | ccccAGcuGuAccccuucudTsdT | sense |
| 2101-2120 | 1807 | AGAAGGGGUACAGCUGGGG | 1808 | AGAAGGGGuAcAGCUGGGGdTsdT | antis |
| 2104-2123 | 1809 | CAGCUGUACCCCUUCUUGU | 1810 | cAGcuGuAccccuucuuGudTsdT | sense |
| 2104-2123 | 1811 | ACAAGAAGGGGUACAGCUG | 1812 | AcAAGAAGGGGuAcAGCUGdTsdT | antis |
| 2105-2124 | 1813 | AGCUGUACCCCUUCUUGUC | 1814 | AGcuGuAccccuucuuGucdTsdT | sense |
| 2105-2124 | 1815 | GACAAGAAGGGGUACAGCU | 1816 | GAcAAGAAGGGGuAcAGCUdTsdT | antis |
| 2155-2174 | 1817 | UCCUGGAAGGAGGGGAGUA | 1818 | uccuGGAAGGAGGGGAGuAdTsdT | sense |
| 2155-2174 | 1819 | UACUCCCCUCCUUCCAGGA | 1820 | uACUCCCCUCCUUCcAGGAdTsdT | antis |
| 2167-2186 | 1821 | GGGAGUAGAGAGAGUCCCU | 1822 | GGGAGuAGAGAGAGucccudTsdT | sense |
| 2167-2186 | 1823 | AGGGACUCUCUCUACUCCC | 1824 | AGGGACUCUCUCuACUCCCdTsdT | antis |
| 2174-2193 | 1825 | GAGAGAGUCCCUGGUGUCU | 1826 | GAGAGAGucccuGGuGucudTsdT | sense |
| 2174-2193 | 1827 | AGACACCAGGGACUCUCUC | 1828 | AGAcAccAGGGACUCUCUCdTsdT | antis |
| 2216-2235 | 1829 | UGUGUACAGACCUCUGUUC | 1830 | uGuGuAcAGAccucuGuucdTsdT | sense |
| 2216-2235 | 1831 | GAACAGAGGUCUGUACACA | 1832 | GAAcAGAGGUCUGuAcAcAdTsdT | antis |
| 2217-2236 | 1833 | GUGUACAGACCUCUGUUCA | 1834 | GuGuAcAGAccucuGuucAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2217-2236 | 1835 | UGAACAGAGGUCUGUACAC | 1836 | UGAAcAGAGGUCUGuAcACdTsdT | antis |
| 2236-2255 | 1837 | AUAAAUUAUUGGCAUGAAA | 1838 | AuAAAuuAuuGGcAuGAAAdTsdT | sense |
| 2236-2255 | 1839 | UUUCAUGCCAAUAAUUUAU | 1840 | UUUcAUGCcAAuAAUUuAUdTsdT | antis |
| 2237-2256 | 1841 | UAAAUUAUUGGCAUGAAAC | 1842 | uAAAuuAuuGGcAuGAAAcdTsdT | sense |
| 2237-2256 | 1843 | GUUUCAUGCCAAUAAUUUA | 1844 | GUUUcAUGCcAAuAAUUuAdTsdT | antis |
| 2245-2264 | 1845 | UGGCAUGAAACCCUUAAAA | 1846 | uGGcAuGAAAcccuuAAAAdTsdT | sense |
| 2245-2264 | 1847 | UUUUAAGGGUUUCAUGCCA | 1848 | UUUUuAAGGGUUUcAUGCcAdTsdT | antis |
| 13-32 | 1849 | AAGCCGACGGCAGAGGGAC | 1850 | AAGccGAcGGcAGAGGGAcdTsdT | sense |
| 13-32 | 1851 | GUCCCUCUGCCGUCGGCUU | 1852 | GUCCCUCUGCCGUCGGCUUdTsdT | antis |
| 21-40 | 1853 | GGCAGAGGGACUUCAUCUC | 1854 | GGcAGAGGGAcuucAucucdTsdT | sense |
| 21-40 | 1855 | GAGAUGAAGUCCCUCUGCC | 1856 | GAGAUGAAGUCCCUCUGCCdTsdT | antis |
| 22-41 | 1857 | GCAGAGGGACUUCAUCUCC | 1858 | GcAGAGGGAcuucAucuccdTsdT | sense |
| 22-41 | 1859 | GGAGAUGAAGUCCCUCUGC | 1860 | GGAGAUGAAGUCCCUCUGCdTsdT | antis |
| 23-42 | 1861 | CAGAGGGACUUCAUCUCCC | 1862 | cAGAGGGAcuucAucucccdTsdT | sense |
| 23-42 | 1863 | GGGAGAUGAAGUCCCUCUG | 1864 | GGGAGAUGAAGUCCCUCUGdTsdT | antis |
| 25-44 | 1865 | GAGGGACUUCAUCUCCCGG | 1866 | GAGGGAcuucAucucccGGdTsdT | sense |
| 25-44 | 1867 | CCGGGAGAUGAAGUCCCUC | 1868 | CCGGGAGAUGAAGUCCCUCdTsdT | antis |
| 30-49 | 1869 | ACUUCAUCUCCCGGCGUGC | 1870 | AcuucAucucccGGcGuGcdTsdT | sense |
| 30-49 | 1871 | GCACGCCGGGAGAUGAAGU | 1872 | GcACGCCGGGAGAUGAAGUdTsdT | antis |
| 31-50 | 1873 | CUUCAUCUCCCGGCGUGCC | 1874 | cuucAucucccGGcGuGccdTsdT | sense |
| 31-50 | 1875 | GGCACGCCGGGAGAUGAAG | 1876 | GGcACGCCGGGAGAUGAAGdTsdT | antis |
| 32-51 | 1877 | UUCAUCUCCCGGCGUGCCC | 1878 | uucAucucccGGcGuGcccdTsdT | sense |
| 32-51 | 1879 | GGGCACGCCGGGAGAUGAA | 1880 | GGGcACGCCGGGAGAUGAAdTsdT | antis |
| 36-55 | 1881 | UCUCCCGGCGUGCCCCGCG | 1882 | ucucccGGcGuGccccGcGdTsdT | sense |
| 36-55 | 1883 | CGCGGGGCACGCCGGGAGA | 1884 | CGCGGGGcACGCCGGGAGAdTsdT | antis |
| 41-60 | 1885 | CGGCGUGCCCCGCGGCGGG | 1886 | cGGcGuGccccGcGGcGGGdTsdT | sense |
| 41-60 | 1887 | CCCGCCGCGGGGCACGCCG | 1888 | CCCGCCGCGGGGcACGCCGdTsdT | antis |
| 44-63 | 1889 | CGUGCCCCGCGGCGGGCGC | 1890 | cGuGccccGcGGcGGGcGcdTsdT | sense |
| 44-63 | 1891 | GCGCCCGCCGCGGGGCACG | 1892 | GCGCCCGCCGCGGGGcACGdTsdT | antis |
| 45-64 | 1893 | GUGCCCCGCGGCGGGCGCU | 1894 | GuGccccGcGGcGGGcGcudTsdT | sense |
| 45-64 | 1895 | AGCGCCCGCCGCGGGGCAC | 1896 | AGCGCCCGCCGCGGGGcACdTsdT | antis |
| 52-71 | 1897 | GCGGCGGGCGCUGGGCCGG | 1898 | GcGGcGGGcGcuGGGccGGdTsdT | sense |
| 52-71 | 1899 | CCGGCCCAGCGCCCGCCGC | 1900 | CCGGCCcAGCGCCCGCCGCdTsdT | antis |
| 58-77 | 1901 | GGCGCUGGGCCGGAGCCGG | 1902 | GGcGcuGGGccGGAGccGGdTsdT | sense |
| 58-77 | 1903 | CCGGCUCCGGCCCAGCGCC | 1904 | CCGGCUCCGGCCcAGCGCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 84-103 | 1905 | ACGGCGCGGCCUGGAAGAG | 1906 | AcGGcGcGGccuGGAAGAGdTsdT | sense |
| 84-103 | 1907 | CUCUUCCAGGCCGCGCCGU | 1908 | CUCUUCcAGGCCGCGCCGUdTsdT | antis |
| 88-107 | 1909 | CGCGGCCUGGAAGAGGCCG | 1910 | cGcGGccuGGAAGAGGccGdTsdT | sense |
| 88-107 | 1911 | CGGCCUCUUCCAGGCCGCG | 1912 | CGGCCUCUUCcAGGCCGCGdTsdT | antis |
| 94-113 | 1913 | CUGGAAGAGGCCGGAGCCC | 1914 | cuGGAAGAGGccGGAGcccdTsdT | sense |
| 94-113 | 1915 | GGGCUCCGGCCUCUUCCAG | 1916 | GGGCUCCGGCCUCUUCcAGdTsdT | antis |
| 98-117 | 1917 | AAGAGGCCGGAGCCCAGGG | 1918 | AAGAGGccGGAGcccAGGGdTsdT | sense |
| 98-117 | 1919 | CCCUGGGCUCCGGCCUCUU | 1920 | CCCUGGGCUCCGGCCUCUUdTsdT | antis |
| 100-119 | 1921 | GAGGCCGGAGCCCAGGGGA | 1922 | GAGGccGGAGcccAGGGGAdTsdT | sense |
| 100-119 | 1923 | UCCCCUGGGCUCCGGCCUC | 1924 | UCCCCUGGGCUCCGGCCUCdTsdT | antis |
| 144-163 | 1925 | GCAGCCCAGGCAGCCCGAG | 1926 | GcAGcccAGGcAGcccGAGdTsdT | sense |
| 144-163 | 1927 | CUCGGGCUGCCUGGGCUGC | 1928 | CUCGGGCUGCCUGGGCUGCdTsdT | antis |
| 145-164 | 1929 | CAGCCCAGGCAGCCCGAGC | 1930 | cAGcccAGGcAGcccGAGcdTsdT | sense |
| 145-164 | 1931 | GCUCGGGCUGCCUGGGCUG | 1932 | GCUCGGGCUGCCUGGGCUGdTsdT | antis |
| 148-167 | 1933 | CCCAGGCAGCCCGAGCCCC | 1934 | cccAGGcAGcccGAGccccdTsdT | sense |
| 148-167 | 1935 | GGGGCUCGGGCUGCCUGGG | 1936 | GGGGCUCGGGCUGCCUGGGdTsdT | antis |
| 149-168 | 1937 | CCAGGCAGCCCGAGCCCCG | 1938 | ccAGGcAGcccGAGccccGdTsdT | sense |
| 149-168 | 1939 | CGGGGCUCGGGCUGCCUGG | 1940 | CGGGGCUCGGGCUGCCUGGdTsdT | antis |
| 157-176 | 1941 | CCCGAGCCCCGCGGCCUGG | 1942 | cccGAGccccGcGGccuGGdTsdT | sense |
| 157-176 | 1943 | CCAGGCCGCGGGGCUCGGG | 1944 | CcAGGCCGCGGGGCUCGGGdTsdT | antis |
| 168-187 | 1945 | CGGCCUGGGCCUGCGCUCG | 1946 | cGGccuGGGccuGcGcucGdTsdT | sense |
| 168-187 | 1947 | CGAGCGCAGGCCCAGGCCG | 1948 | CGAGCGcAGGCCcAGGCCGdTsdT | antis |
| 169-188 | 1949 | GGCCUGGGCCUGCGCUCGG | 1950 | GGccuGGGccuGcGcucGGdTsdT | sense |
| 169-188 | 1951 | CCGAGCGCAGGCCCAGGCC | 1952 | CCGAGCGcAGGCCcAGGCCdTsdT | antis |
| 175-194 | 1953 | GGCCUGCGCUCGGCGCCAU | 1954 | GGccuGcGcucGGcGccAudTsdT | sense |
| 175-194 | 1955 | AUGGCGCCGAGCGCAGGCC | 1956 | AUGGCGCCGAGCGcAGGCCdTsdT | antis |
| 179-198 | 1957 | UGCGCUCGGCGCCAUGAGC | 1958 | uGcGcucGGcGccAuGAGcdTsdT | sense |
| 179-198 | 1959 | GCUCAUGGCGCCGAGCGCA | 1960 | GCUcAUGGCGCCGAGCGcAdTsdT | antis |
| 192-211 | 1961 | AUGAGCGGCGGCGGGCCUU | 1962 | AuGAGcGGcGGcGGGccuudTsdT | sense |
| 192-211 | 1963 | AAGGCCCGCCGCCGCUCAU | 1964 | AAGGCCCGCCGCCGCUcAUdTsdT | antis |
| 193-212 | 1965 | UGAGCGGCGGCGGGCCUUC | 1966 | uGAGcGGcGGcGGGccuucdTsdT | sense |
| 193-212 | 1967 | GAAGGCCCGCCGCCGCUCA | 1968 | GAAGGCCCGCCGCCGCUcAdTsdT | antis |
| 194-213 | 1969 | GAGCGGCGGCGGGCCUUCG | 1970 | GAGcGGcGGcGGGccuucGdTsdT | sense |
| 194-213 | 1971 | CGAAGGCCCGCCGCCGCUC | 1972 | CGAAGGCCCGCCGCCGCUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 195-214 | 1973 | AGCGGCGGCGGGCCUUCGG | 1974 | AGcGGcGGcGGGccuucGGdTsdT | sense |
| 195-214 | 1975 | CCGAAGGCCCGCCGCCGCU | 1976 | CCGAAGGCCCGCCGCCGCUdTsdT | antis |
| 197-216 | 1977 | CGGCGGCGGGCCUUCGGGA | 1978 | cGGcGGcGGGccuucGGGAdTsdT | sense |
| 197-216 | 1979 | UCCCGAAGGCCCGCCGCCG | 1980 | UCCCGAAGGCCCGCCGCCGdTsdT | antis |
| 200-219 | 1981 | CGGCGGGCCUUCGGGAGGC | 1982 | cGGcGGGccuucGGGAGGcdTsdT | sense |
| 200-219 | 1983 | GCCUCCCGAAGGCCCGCCG | 1984 | GCCUCCCGAAGGCCCGCCGdTsdT | antis |
| 246-265 | 1985 | ACCAGCUCGUUCGCGGAGC | 1986 | AccAGcucGuucGcGGAGcdTsdT | sense |
| 246-265 | 1987 | GCUCCGCGAACGAGCUGGU | 1988 | GCUCCGCGAACGAGCUGGUdTsdT | antis |
| 253-272 | 1989 | CGUUCGCGGAGCCAGGAGG | 1990 | cGuucGcGGAGccAGGAGGdTsdT | sense |
| 253-272 | 1991 | CCUCCUGGCUCCGCGAACG | 1992 | CCUCCUGGCUCCGCGAACGdTsdT | antis |
| 257-276 | 1993 | CGCGGAGCCAGGAGGCGGA | 1994 | cGcGGAGccAGGAGGcGGAdTsdT | sense |
| 257-276 | 1995 | UCCGCCUCCUGGCUCCGCG | 1996 | UCCGCCUCCUGGCUCCGCGdTsdT | antis |
| 258-277 | 1997 | GCGGAGCCAGGAGGCGGAG | 1998 | GcGGAGccAGGAGGcGGAGdTsdT | sense |
| 258-277 | 1999 | CUCCGCCUCCUGGCUCCGC | 2000 | CUCCGCCUCCUGGCUCCGCdTsdT | antis |
| 297-316 | 2001 | CCCGGGGGCUCGGCCUCUG | 2002 | cccGGGGGcucGGccucuGdTsdT | sense |
| 297-316 | 2003 | CAGAGGCCGAGCCCCCGGG | 2004 | cAGAGGCCGAGCCCCCGGGdTsdT | antis |
| 298-317 | 2005 | CCGGGGGCUCGGCCUCUGG | 2006 | ccGGGGGcucGGccucuGGdTsdT | sense |
| 298-317 | 2007 | CCAGAGGCCGAGCCCCCGG | 2008 | CcAGAGGCCGAGCCCCCGGdTsdT | antis |
| 321-340 | 2009 | GGAGGCACUGGCGGCGGGA | 2010 | GGAGGcAcuGGcGGcGGGAdTsdT | sense |
| 321-340 | 2011 | UCCCGCCGCCAGUGCCUCC | 2012 | UCCCGCCGCCAGUGCCUCCdTsdT | antis |
| 323-342 | 2013 | AGGCACUGGCGGCGGGAAA | 2014 | AGGcAcuGGcGGcGGGAAAdTsdT | sense |
| 323-342 | 2015 | UUUCCCGCCGCCAGUGCCU | 2016 | UUUCCCGCCGCCAGUGCCUdTsdT | antis |
| 325-344 | 2017 | GCACUGGCGGCGGGAAAGC | 2018 | GcAcuGGcGGcGGGAAAGcdTsdT | sense |
| 325-344 | 2019 | GCUUUCCCGCCGCCAGUGC | 2020 | GCUUUCCCGCCGCCAGUGCdTsdT | antis |
| 326-345 | 2021 | CACUGGCGGCGGGAAAGCG | 2022 | cAcuGGcGGcGGGAAAGcGdTsdT | sense |
| 326-345 | 2023 | CGCUUUCCCGCCGCCAGUG | 2024 | CGCUUUCCCGCCGCCAGUGdTsdT | antis |
| 338-357 | 2025 | GAAAGCGUCAGUCGGGGCU | 2026 | GAAAGcGucAGucGGGGcudTsdT | sense |
| 338-357 | 2027 | AGCCCCGACUGACGCUUUC | 2028 | AGCCCCGACUGACGCUUUCdTsdT | antis |
| 370-389 | 2029 | UGGGAGCCUCGAGCUCCGG | 2030 | uGGGAGccucGAGcuccGGdTsdT | sense |
| 370-389 | 2031 | CCGGAGCUCGAGGCUCCCA | 2032 | CCGGAGCUCGAGGCUCCcAdTsdT | antis |
| 371-390 | 2033 | GGGAGCCUCGAGCUCCGGG | 2034 | GGGAGccucGAGcuccGGGdTsdT | sense |
| 371-390 | 2035 | CCCGGAGCUCGAGGCUCCC | 2036 | CCCGGAGCUCGAGGCUCCCdTsdT | antis |
| 372-391 | 2037 | GGAGCCUCGAGCUCCGGGG | 2038 | GGAGccucGAGcuccGGGGdTsdT | sense |
| 372-391 | 2039 | CCCCGGAGCUCGAGGCUCC | 2040 | CCCCGGAGCUCGAGGCUCCdTsdT | antis |
| 373-392 | 2041 | GAGCCUCGAGCUCCGGGGG | 2042 | GAGccucGAGcuccGGGGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 373-392 | 2043 | CCCCCGGAGCUCGAGGCUC | 2044 | CCCCCGGAGCUCGAGGCUCdTsdT | antis |
| 375-394 | 2045 | GCCUCGAGCUCCGGGGUG | 2046 | GccucGAGcuccGGGGGuGdTsdT | sense |
| 375-394 | 2047 | CACCCCGGAGCUCGAGGC | 2048 | cACCCCCGGAGCUCGAGGCdTsdT | antis |
| 380-399 | 2049 | GAGCUCCGGGGUGGCCCC | 2050 | GAGcuccGGGGGuGGccccdTsdT | sense |
| 380-399 | 2051 | GGGGCCACCCCCGGAGCUC | 2052 | GGGGCcACCCCCGGAGCUCdTsdT | antis |
| 385-404 | 2053 | CCGGGGGUGGCCCCAGCGG | 2054 | ccGGGGGuGGccccAGcGGdTsdT | sense |
| 385-404 | 2055 | CCGCUGGGGCCACCCCCGG | 2056 | CCGCUGGGGCcACCCCCGGdTsdT | antis |
| 389-408 | 2057 | GGGUGGCCCCAGCGGCAGC | 2058 | GGGuGGccccAGcGGcAGcdTsdT | sense |
| 389-408 | 2059 | GCUGCCGCUGGGGCCACCC | 2060 | GCUGCCGCUGGGGCcACCCdTsdT | antis |
| 439-458 | 2061 | GCACUAGCUUCCCGCCGCC | 2062 | GcAcuAGcuucccGccGccdTsdT | sense |
| 439-458 | 2063 | GGCGGCGGGAAGCUAGUGC | 2064 | GGCGGCGGGAAGCuAGUGCdTsdT | antis |
| 440-459 | 2065 | CACUAGCUUCCCGCCGCCG | 2066 | cAcuAGcuucccGccGccGdTsdT | sense |
| 440-459 | 2067 | CGGCGGCGGGAAGCUAGUG | 2068 | CGGCGGCGGGAAGCuAGUGdTsdT | antis |
| 445-464 | 2069 | GCUUCCCGCCGCCGGGAGU | 2070 | GcuucccGccGccGGGAGudTsdT | sense |
| 445-464 | 2071 | ACUCCCGGCGGCGGGAAGC | 2072 | ACUCCCGGCGGCGGGAAGCdTsdT | antis |
| 447-466 | 2073 | UUCCCGCCGCCGGGAGUGA | 2074 | uucccGccGccGGGAGuGAdTsdT | sense |
| 447-466 | 2075 | UCACUCCCGGCGGCGGGAA | 2076 | UcACUCCCGGCGGCGGGAAdTsdT | antis |
| 463-482 | 2077 | UGAAGCUGGGCCGUGACAG | 2078 | uGAAGcuGGGccGuGAcAGdTsdT | sense |
| 463-482 | 2079 | CUGUCACGGCCCAGCUUCA | 2080 | CUGUcACGGCCcAGCUUcAdTsdT | antis |
| 471-490 | 2081 | GGCCGUGACAGCGGGAAGG | 2082 | GGccGuGAcAGcGGGAAGGdTsdT | sense |
| 471-490 | 2083 | CCUUCCCGCUGUCACGGCC | 2084 | CCUUCCCGCUGUcACGGCCdTsdT | antis |
| 474-493 | 2085 | CGUGACAGCGGGAAGGUGA | 2086 | cGuGAcAGcGGGAAGGuGAdTsdT | sense |
| 474-493 | 2087 | UCACCUUCCCGCUGUCACG | 2088 | UcACCUUCCCGCUGUcACGdTsdT | antis |
| 492-511 | 2089 | ACCACAGUGGUAGCCACUG | 2090 | AccAcAGuGGuAGccAcuGdTsdT | sense |
| 492-511 | 2091 | CAGUGGCUACCACUGUGGU | 2092 | cAGUGGCuAccACUGUGGUdTsdT | antis |
| 495-514 | 2093 | ACAGUGGUAGCCACUGUAG | 2094 | AcAGuGGuAGccAcuGuAGdTsdT | sense |
| 495-514 | 2095 | CUACAGUGGCUACCACUGU | 2096 | CuAcAGUGGCuAccACUGUdTsdT | antis |
| 496-515 | 2097 | CAGUGGUAGCCACUGUAGG | 2098 | cAGuGGuAGccAcuGuAGGdTsdT | sense |
| 496-515 | 2099 | CCUACAGUGGCUACCACUG | 2100 | CCuAcAGUGGCuAccACUGdTsdT | antis |
| 506-525 | 2101 | CACUGUAGGCCAAGGCCCA | 2102 | cAcuGuAGGccAAGGcccAdTsdT | sense |
| 506-525 | 2103 | UGGGCCUUGGCCUACAGUG | 2104 | UGGGCCUUGGCCuAcAGUGdTsdT | antis |
| 507-526 | 2105 | ACUGUAGGCCAAGGCCCAG | 2106 | AcuGuAGGccAAGGcccAGdTsdT | sense |
| 507-526 | 2107 | CUGGGCCUUGGCCUACAGU | 2108 | CUGGGCCUUGGCCuAcAGUdTsdT | antis |
| 509-528 | 2109 | UGUAGGCCAAGGCCCAGAG | 2110 | uGuAGGccAAGGcccAGAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 509-528 | 2111 | CUCUGGGCCUUGGCCUACA | 2112 | CUCUGGGCCUUGGCCuAcAdTsdT | antis |
| 510-529 | 2113 | GUAGGCCAAGGCCCAGAGC | 2114 | GuAGGccAAGGcccAGAGCdTsdT | sense |
| 510-529 | 2115 | GCUCUGGGCCUUGGCCUAC | 2116 | GCUCUGGGCCUUGGCCuACdTsdT | antis |
| 582-601 | 2117 | GGAGUAGUAUACCAGGCAC | 2118 | GGAGuAGuAuAccAGGcAcdTsdT | sense |
| 582-601 | 2119 | GUGCCUGGUAUACUACUCC | 2120 | GUGCCUGGuAuAcUACUCCdTsdT | antis |
| 585-604 | 2121 | GUAGUAUACCAGGCACGGC | 2122 | GuAGuAuAccAGGcAcGGcdTsdT | sense |
| 585-604 | 2123 | GCCGUGCCUGGUAUACUAC | 2124 | GCCGUGCCUGGuAuAcUACdTsdT | antis |
| 595-614 | 2125 | AGGCACGGCUGGCAGAGAC | 2126 | AGGcAcGGcuGGcAGAGAcdTsdT | sense |
| 595-614 | 2127 | GUCUCUGCCAGCCGUGCCU | 2128 | GUCUCUGCcAGCCGUGCCUdTsdT | antis |
| 596-615 | 2129 | GGCACGGCUGGCAGAGACG | 2130 | GGcAcGGcuGGcAGAGAcGdTsdT | sense |
| 596-615 | 2131 | CGUCUCUGCCAGCCGUGCC | 2132 | CGUCUCUGCcAGCCGUGCCdTsdT | antis |
| 597-616 | 2133 | GCACGGCUGGCAGAGACGA | 2134 | GcAcGGcuGGcAGAGAcGAdTsdT | sense |
| 597-616 | 2135 | UCGUCUCUGCCAGCCGUGC | 2136 | UCGUCUCUGCcAGCCGUGCdTsdT | antis |
| 610-629 | 2137 | AGACGAGGGAACUGGUGGC | 2138 | AGAcGAGGGAAcuGGuGGcdTsdT | sense |
| 610-629 | 2139 | GCCACCAGUUCCCUCGUCU | 2140 | GCcACcAGUUCCCUCGUCUdTsdT | antis |
| 612-631 | 2141 | ACGAGGGAACUGGUGGCCA | 2142 | AcGAGGGAAcuGGuGGccAdTsdT | sense |
| 612-631 | 2143 | UGGCCACCAGUUCCCUCGU | 2144 | UGGCcACcAGUUCCCUCGUdTsdT | antis |
| 614-633 | 2145 | GAGGGAACUGGUGGCCAUC | 2146 | GAGGGAAcuGGuGGccAucdTsdT | sense |
| 614-633 | 2147 | GAUGGCCACCAGUUCCCUC | 2148 | GAUGGCcACcAGUUCCCUCdTsdT | antis |
| 646-665 | 2149 | AGGACAAAAGGUUCAAGAA | 2150 | AGGAcAAAAGGuucAAGAAdTsdT | sense |
| 646-665 | 2151 | UUCUUGAACCUUUUGUCCU | 2152 | UUCUUGAACCUUUUGUCCUdTsdT | antis |
| 661-680 | 2153 | AGAACCGAGAACUGCAGAU | 2154 | AGAAccGAGAAcuGcAGAudTsdT | sense |
| 661-680 | 2155 | AUCUGCAGUUCUCGGUUCU | 2156 | AUCUGcAGUUCUCGGUUCUdTsdT | antis |
| 668-687 | 2157 | AGAACUGCAGAUUAUGCGU | 2158 | AGAAcuGcAGAuuAuGcGudTsdT | sense |
| 668-687 | 2159 | ACGCAUAAUCUGCAGUUCU | 2160 | ACGcAuAAUCUGcAGUUCUdTsdT | antis |
| 669-688 | 2161 | GAACUGCAGAUUAUGCGUA | 2162 | GAAcuGcAGAuuAuGcGuAdTsdT | sense |
| 669-688 | 2163 | UACGCAUAAUCUGCAGUUC | 2164 | uACGcAuAAUCUGcAGUUCdTsdT | antis |
| 703-722 | 2165 | AUAUUGUGAGGCUGCGGUA | 2166 | AuAuuGuGAGGcuGcGGuAdTsdT | sense |
| 703-722 | 2167 | UACCGCAGCCUCACAAUAU | 2168 | uACCGcAGCCUcAcAAuAUdTsdT | antis |
| 704-723 | 2169 | UAUUGUGAGGCUGCGGUAC | 2170 | uAuuGuGAGGcuGcGGuAcdTsdT | sense |
| 704-723 | 2171 | GUACCGCAGCCUCACAAUA | 2172 | GuACCGcAGCCUcAcAAuAdTsdT | antis |
| 705-724 | 2173 | AUUGUGAGGCUGCGGUACU | 2174 | AuuGuGAGGcuGcGGuAcudTsdT | sense |
| 705-724 | 2175 | AGUACCGCAGCCUCACAAU | 2176 | AGuACCGcAGCCUcAcAAUdTsdT | antis |
| 738-757 | 2177 | GGGGAGAAGAAGGACGAGC | 2178 | GGGGAGAAGAAGGAcGAGcdTsdT | sense |
| 738-757 | 2179 | GCUCGUCCUUCUUCUCCCC | 2180 | GCUCGUCCUUCUUCUCCCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 824-843 | 2181 | GGCCAAGCUGAUCACCCCU | 2182 | GGccAAGcuGAucAccccudTsdT | sense |
| 824-843 | 2183 | AGGGGUGAUCAGCUUGGCC | 2184 | AGGGGUGAUcAGCUUGGCCdTsdT | antis |
| 827-846 | 2185 | CAAGCUGAUCACCCCUAUC | 2186 | cAAGcuGAucAccccuAucdTsdT | sense |
| 827-846 | 2187 | GAUAGGGGUGAUCAGCUUG | 2188 | GAuAGGGGUGAUcAGCUUGdTsdT | antis |
| 879-898 | 2189 | CGGAGCUUGGCCUACAUCC | 2190 | cGGAGcuuGGccuAcAuccdTsdT | sense |
| 879-898 | 2191 | GGAUGUAGGCCAAGCUCCG | 2192 | GGAUGuAGGCcAAGCUCCGdTsdT | antis |
| 880-899 | 2193 | GGAGCUUGGCCUACAUCCA | 2194 | GGAGcuuGGccuAcAuccAdTsdT | sense |
| 880-899 | 2195 | UGGAUGUAGGCCAAGCUCC | 2196 | UGGAUGuAGGCcAAGCUCCdTsdT | antis |
| 881-900 | 2197 | GAGCUUGGCCUACAUCCAC | 2198 | GAGcuuGGccuAcAuccAcdTsdT | sense |
| 881-900 | 2199 | GUGGAUGUAGGCCAAGCUC | 2200 | GUGGAUGuAGGCcAAGCUCdTsdT | antis |
| 884-903 | 2201 | CUUGGCCUACAUCCACUCC | 2202 | cuuGGccuAcAuccAcuccdTsdT | sense |
| 884-903 | 2203 | GGAGUGGAUGUAGGCCAAG | 2204 | GGAGUGGAUGuAGGCcAAGdTsdT | antis |
| 886-905 | 2205 | UGGCCUACAUCCACUCCCA | 2206 | uGGccuAcAuccAcucccAdTsdT | sense |
| 886-905 | 2207 | UGGGAGUGGAUGUAGGCCA | 2208 | UGGGAGUGGAUGuAGGCcAdTsdT | antis |
| 896-915 | 2209 | CCACUCCCAAGGUGUGUGU | 2210 | ccAcucccAAGGuGuGuGudTsdT | sense |
| 896-915 | 2211 | ACACACACCUUGGGAGUGG | 2212 | AcAcAcACCUUGGGAGUGGdTsdT | antis |
| 916-935 | 2213 | ACCGUGACAUCAAGCCCCA | 2214 | AccGuGAcAucAAGccccAdTsdT | sense |
| 916-935 | 2215 | UGGGGCUUGAUGUCACGGU | 2216 | UGGGGCUUGAUGUcACGGUdTsdT | antis |
| 917-936 | 2217 | CCGUGACAUCAAGCCCCAG | 2218 | ccGuGAcAucAAGccccAGdTsdT | sense |
| 917-936 | 2219 | CUGGGGCUUGAUGUCACGG | 2220 | CUGGGGCUUGAUGUcACGGdTsdT | antis |
| 931-950 | 2221 | CCCAGAAUUUGCUUGUGGA | 2222 | cccAGAAuuuGcuuGuGGAdTsdT | sense |
| 931-950 | 2223 | UCCACAAGCAAAUUCUGGG | 2224 | UCcAcAAGcAAAUUCUGGGdTsdT | antis |
| 933-952 | 2225 | CAGAAUUUGCUUGUGGACC | 2226 | cAGAAuuuGcuuGuGGAccdTsdT | sense |
| 933-952 | 2227 | GGUCCACAAGCAAAUUCUG | 2228 | GGUCcAcAAGcAAAUUCUGdTsdT | antis |
| 991-1010 | 2229 | CAAAGCAGCUGGUUCGGGG | 2230 | cAAAGcAGcuGGuucGGGGdTsdT | sense |
| 991-1010 | 2231 | CCCCGAACCAGCUGCUUUG | 2232 | CCCCGAACcAGCUGCUUUGdTsdT | antis |
| 993-1012 | 2233 | AAGCAGCUGGUUCGGGGGG | 2234 | AAGcAGcuGGuucGGGGGGdTsdT | sense |
| 993-1012 | 2235 | CCCCCCGAACCAGCUGCUU | 2236 | CCCCCCGAACcAGCUGCUUdTsdT | antis |
| 1000-1019 | 2237 | UGGUUCGGGGGAGCCCAA | 2238 | uGGuucGGGGGAGcccAAdTsdT | sense |
| 1000-1019 | 2239 | UUGGGCUCCCCCCGAACCA | 2240 | UUGGGCUCCCCCCGAACcAdTsdT | antis |
| 1003-1022 | 2241 | UUCGGGGGGAGCCCAAUGU | 2242 | uucGGGGGGAGcccAAuGudTsdT | sense |
| 1003-1022 | 2243 | ACAUUGGGCUCCCCCCGAA | 2244 | AcAUUGGGCUCCCCCCGAAdTsdT | antis |
| 1004-1023 | 2245 | UCGGGGGAGCCCAAUGUG | 2246 | ucGGGGGGAGcccAAuGuGdTsdT | sense |
| 1004-1023 | 2247 | CACAUUGGGCUCCCCCCGA | 2248 | cAcAUUGGGCUCCCCCCGAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1006-1025 | 2249 | GGGGGGAGCCCAAUGUGUC | 2250 | GGGGGGAGcccAAuGuGucdTsdT | sense |
| 1006-1025 | 2251 | GACACAUUGGGCUCCCCCC | 2252 | GAcAcAUUGGGCUCCCCCCdTsdT | antis |
| 1015-1034 | 2253 | CCAAUGUGUCCUACAUCUG | 2254 | ccAAuGuGuccuAcAucuGdTsdT | sense |
| 1015-1034 | 2255 | CAGAUGUAGGACACAUUGG | 2256 | cAGAUGuAGGAcAcAUUGGdTsdT | antis |
| 1016-1035 | 2257 | CAAUGUGUCCUACAUCUGC | 2258 | cAAuGuGuccuAcAucuGcdTsdT | sense |
| 1016-1035 | 2259 | GCAGAUGUAGGACACAUUG | 2260 | GcAGAUGuAGGAcAcAUUGdTsdT | antis |
| 1031-1050 | 2261 | CUGCUCUCGGUACUACCGU | 2262 | cuGcucucGGuAcuAccGudTsdT | sense |
| 1031-1050 | 2263 | ACGGUAGUACCGAGAGCAG | 2264 | ACGGuAGuACCGAGAGcAGdTsdT | antis |
| 1045-1064 | 2265 | ACCGUGCUCCAGAACUCAU | 2266 | AccGuGcuccAGAAcucAudTsdT | sense |
| 1045-1064 | 2267 | AUGAGUUCUGGAGCACGGU | 2268 | AUGAGUUCUGGAGcACGGUdTsdT | antis |
| 1047-1066 | 2269 | CGUGCUCCAGAACUCAUCU | 2270 | cGuGcuccAGAAcucAucudTsdT | sense |
| 1047-1066 | 2271 | AGAUGAGUUCUGGAGCACG | 2272 | AGAUGAGUUCUGGAGcACGdTsdT | antis |
| 1051-1070 | 2273 | CUCCAGAACUCAUCUUUGG | 2274 | cuccAGAAcucAucuuuGGdTsdT | sense |
| 1051-1070 | 2275 | CCAAAGAUGAGUUCUGGAG | 2276 | CcAAAGAUGAGUUCUGGAGdTsdT | antis |
| 1055-1074 | 2277 | AGAACUCAUCUUUGGAGCC | 2278 | AGAAcucAucuuuGGAGccdTsdT | sense |
| 1055-1074 | 2279 | GGCUCCAAAGAUGAGUUCU | 2280 | GGCUCcAAAGAUGAGUUCUdTsdT | antis |
| 1058-1077 | 2281 | ACUCAUCUUUGGAGCCACA | 2282 | AcucAucuuuGGAGccAcAdTsdT | sense |
| 1058-1077 | 2283 | UGUGGCUCCAAAGAUGAGU | 2284 | UGUGGCUCcAAAGAUGAGUdTsdT | antis |
| 1061-1080 | 2285 | CAUCUUUGGAGCCACAGAU | 2286 | cAucuuuGGAGccAcAGAudTsdT | sense |
| 1061-1080 | 2287 | AUCUGUGGCUCCAAAGAUG | 2288 | AUCUGUGGCUCcAAAGAUGdTsdT | antis |
| 1062-1081 | 2289 | AUCUUUGGAGCCACAGAUU | 2290 | AucuuuGGAGccAcAGAuudTsdT | sense |
| 1062-1081 | 2291 | AAUCUGUGGCUCCAAAGAU | 2292 | AAUCUGUGGCUCcAAAGAUdTsdT | antis |
| 1086-1105 | 2293 | UCGUCCAUCGAUGUGUGGU | 2294 | ucGuccAucGAuGuGuGGudTsdT | sense |
| 1086-1105 | 2295 | ACCACACAUCGAUGGACGA | 2296 | ACcAcAcAUCGAUGGACGAdTsdT | antis |
| 1099-1118 | 2297 | UGUGGUCGGCUGGCUGUGU | 2298 | uGuGGucGGcuGGcuGuGudTsdT | sense |
| 1099-1118 | 2299 | ACACAGCCAGCCGACCACA | 2300 | AcAcAGCcAGCCGACcAcAdTsdT | antis |
| 1100-1119 | 2301 | GUGGUCGGCUGGCUGUGUA | 2302 | GuGGucGGcuGGcuGuGuAdTsdT | sense |
| 1100-1119 | 2303 | UACACAGCCAGCCGACCAC | 2304 | uAcAcAGCcAGCCGACcACdTsdT | antis |
| 1101-1120 | 2305 | UGGUCGGCUGGCUGUGUAC | 2306 | uGGucGGcuGGcuGuGuAcdTsdT | sense |
| 1101-1120 | 2307 | GUACACAGCCAGCCGACCA | 2308 | GuAcAcAGCcAGCCGACcAdTsdT | antis |
| 1112-1131 | 2309 | CUGUGUACUUGCUGAGCUA | 2310 | cuGuGuAcuuGcuGAGcuAdTsdT | sense |
| 1112-1131 | 2311 | UAGCUCAGCAAGUACACAG | 2312 | uAGCUcAGcAAGuAcAcAGdTsdT | antis |
| 1114-1133 | 2313 | GUGUACUUGCUGAGCUACU | 2314 | GuGuAcuuGcuGAGcuAcudTsdT | sense |
| 1114-1133 | 2315 | AGUAGCUCAGCAAGUACAC | 2316 | AGuAGCUcAGcAAGuAcACdTsdT | antis |
| 1115-1134 | 2317 | UGUACUUGCUGAGCUACUU | 2318 | uGuAcuuGcuGAGcuAcuudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1115-1134 | 2319 | AAGUAGCUCAGCAAGUACA | 2320 | AAGuAGCUcAGcAAGuAcAdTsdT | antis |
| 1119-1138 | 2321 | CUUGCUGAGCUACUUCUCG | 2322 | cuuGcuGAGcuAcuucucGdTsdT | sense |
| 1119-1138 | 2323 | CGAGAAGUAGCUCAGCAAG | 2324 | CGAGAAGuAGCUcAGcAAGdTsdT | antis |
| 1126-1145 | 2325 | AGCUACUUCUCGGCCAGCC | 2326 | AGcuAcuucucGGccAGccdTsdT | sense |
| 1126-1145 | 2327 | GGCUGGCCGAGAAGUAGCU | 2328 | GGCUGGCCGAGAAGuAGCUdTsdT | antis |
| 1139-1158 | 2329 | CCAGCCCAUCUUCCCUGGG | 2330 | ccAGcccAucuucccuGGGdTsdT | sense |
| 1139-1158 | 2331 | CCCAGGGAAGAUGGGCUGG | 2332 | CCcAGGGAAGAUGGGCUGGdTsdT | antis |
| 1146-1165 | 2333 | AUCUUCCCUGGGGACAGUG | 2334 | AucuucccuGGGGAcAGuGdTsdT | sense |
| 1146-1165 | 2335 | CACUGUCCCCAGGGAAGAU | 2336 | cACUGUCCCcAGGGAAGAUdTsdT | antis |
| 1224-1243 | 2337 | CGAGAGAUGAACCCUAACU | 2338 | cGAGAGAuGAAcccuAAcudTsdT | sense |
| 1224-1243 | 2339 | AGUUAGGGUUCAUCUCUCG | 2340 | AGUuAGGGUUcAUCUCUCGdTsdT | antis |
| 1263-1282 | 2341 | CAGAUCAAAGCUCACCCUU | 2342 | cAGAucAAAGcucAcccuudTsdT | sense |
| 1263-1282 | 2343 | AAGGGUGAGCUUUGAUCUG | 2344 | AAGGGUGAGCUUUGAUCUGdTsdT | antis |
| 1264-1283 | 2345 | AGAUCAAAGCUCACCCUUG | 2346 | AGAucAAAGcucAcccuuGdTsdT | sense |
| 1264-1283 | 2347 | CAAGGGUGAGCUUUGAUCU | 2348 | cAAGGGUGAGCUUUGAUCUdTsdT | antis |
| 1267-1286 | 2349 | UCAAAGCUCACCCUUGGAC | 2350 | ucAAAGcucAcccuuGGAcdTsdT | sense |
| 1267-1286 | 2351 | GUCCAAGGGUGAGCUUUGA | 2352 | GUCcAAGGGUGAGCUUUGAdTsdT | antis |
| 1285-1304 | 2353 | CAAAGGUGUUCAAAUCUUC | 2354 | cAAAGGuGuucAAAucuucdTsdT | sense |
| 1285-1304 | 2355 | GAAGAUUUGAACACCUUUG | 2356 | GAAGAUUUGAAcACCUUUGdTsdT | antis |
| 1286-1305 | 2357 | AAAGGUGUUCAAAUCUUCA | 2358 | AAAGGuGuucAAAucuucAdTsdT | sense |
| 1286-1305 | 2359 | UGAAGAUUUGAACACCUUU | 2360 | UGAAGAUUUGAAcACCUUUdTsdT | antis |
| 1295-1314 | 2361 | CAAAUCUUCAAAGACACCA | 2362 | cAAAucuucAAAGAcAccAdTsdT | sense |
| 1295-1314 | 2363 | UGGUGUCUUUGAAGAUUUG | 2364 | UGGUGUCUUUGAAGAUUUGdTsdT | antis |
| 1304-1323 | 2365 | AAAGACACCACCUGAGGCC | 2366 | AAAGAcAccAccuGAGGccdTsdT | sense |
| 1304-1323 | 2367 | GGCCUCAGGUGGUGUCUUU | 2368 | GGCCUcAGGUGGUGUCUUUdTsdT | antis |
| 1306-1325 | 2369 | AGACACCACCUGAGGCCAU | 2370 | AGAcAccAccuGAGGccAudTsdT | sense |
| 1306-1325 | 2371 | AUGGCCUCAGGUGGUGUCU | 2372 | AUGGCCUcAGGUGGUGUCUdTsdT | antis |
| 1307-1326 | 2373 | GACACCACCUGAGGCCAUU | 2374 | GAcAccAccuGAGGccAuudTsdT | sense |
| 1307-1326 | 2375 | AAUGGCCUCAGGUGGUGUC | 2376 | AAUGGCCUcAGGUGGUGUCdTsdT | antis |
| 1310-1329 | 2377 | ACCACCUGAGGCCAUUGCA | 2378 | AccAccuGAGGccAuuGcAdTsdT | sense |
| 1310-1329 | 2379 | UGCAAUGGCCUCAGGUGGU | 2380 | UGcAAUGGCCUcAGGUGGUdTsdT | antis |
| 1313-1332 | 2381 | ACCUGAGGCCAUUGCACUC | 2382 | AccuGAGGccAuuGcAcucdTsdT | sense |
| 1313-1332 | 2383 | GAGUGCAAUGGCCUCAGGU | 2384 | GAGUGcAAUGGCCUcAGGUdTsdT | antis |
| 1315-1334 | 2385 | CUGAGGCCAUUGCACUCUG | 2386 | cuGAGGccAuuGcAcucuGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1315-1334 | 2387 | CAGAGUGCAAUGGCCUCAG | 2388 | cAGAGUGcAAUGGCCUcAGdTsdT | antis |
| 1322-1341 | 2389 | CAUUGCACUCUGCUCUAGC | 2390 | cAuuGcAcucuGcucuAGcdTsdT | sense |
| 1322-1341 | 2391 | GCUAGAGCAGAGUGCAAUG | 2392 | GCuAGAGcAGAGUGcAAUGdTsdT | antis |
| 1330-1349 | 2393 | UCUGCUCUAGCCUACUGGA | 2394 | ucuGcucuAGccuAcuGGAdTsdT | sense |
| 1330-1349 | 2395 | UCCAGUAGGCUAGAGCAGA | 2396 | UCcAGuAGGCuAGAGcAGAdTsdT | antis |
| 1344-1363 | 2397 | CUGGAGUACACGCCAUCCU | 2398 | cuGGAGuAcAcGccAuccudTsdT | sense |
| 1344-1363 | 2399 | AGGAUGGCGUGUACUCCAG | 2400 | AGGAUGGCGUGuACUCcAGdTsdT | antis |
| 1347-1366 | 2401 | GAGUACACGCCAUCCUCAA | 2402 | GAGuAcAcGccAuccucAAdTsdT | sense |
| 1347-1366 | 2403 | UUGAGGAUGGCGUGUACUC | 2404 | UUGAGGAUGGCGUGuACUCdTsdT | antis |
| 1350-1369 | 2405 | UACACGCCAUCCUCAAGGC | 2406 | uAcAcGccAuccucAAGGcdTsdT | sense |
| 1350-1369 | 2407 | GCCUUGAGGAUGGCGUGUA | 2408 | GCCUUGAGGAUGGCGUGuAdTsdT | antis |
| 1366-1385 | 2409 | GGCUCUCCCCACUCGAGGC | 2410 | GGcucuccccAcucGAGGcdTsdT | sense |
| 1366-1385 | 2411 | GCCUCGAGUGGGGAGAGCC | 2412 | GCCUCGAGUGGGGAGAGCCdTsdT | antis |
| 1367-1386 | 2413 | GCUCUCCCCACUCGAGGCU | 2414 | GcucuccccAcucGAGGcudTsdT | sense |
| 1367-1386 | 2415 | AGCCUCGAGUGGGGAGAGC | 2416 | AGCCUCGAGUGGGGAGAGCdTsdT | antis |
| 1368-1387 | 2417 | CUCUCCCCACUCGAGGCUU | 2418 | cucuccccAcucGAGGcuudTsdT | sense |
| 1368-1387 | 2419 | AAGCCUCGAGUGGGGAGAG | 2420 | AAGCCUCGAGUGGGGAGAGdTsdT | antis |
| 1403-1422 | 2421 | CGAUGAACUGCGGAGACUC | 2422 | cGAuGAAcuGcGGAGAcucdTsdT | sense |
| 1403-1422 | 2423 | GAGUCUCCGCAGUUCAUCG | 2424 | GAGUCUCCGcAGUUcAUCGdTsdT | antis |
| 1412-1431 | 2425 | GCGGAGACUCGGAGCCCAG | 2426 | GcGGAGAcucGGAGcccAGdTsdT | sense |
| 1412-1431 | 2427 | CUGGGCUCCGAGUCUCCGC | 2428 | CUGGGCUCCGAGUCUCCGCdTsdT | antis |
| 1413-1432 | 2429 | CGGAGACUCGGAGCCCAGC | 2430 | cGGAGAcucGGAGcccAGcdTsdT | sense |
| 1413-1432 | 2431 | GCUGGGCUCCGAGUCUCCG | 2432 | GCUGGGCUCCGAGUCUCCGdTsdT | antis |
| 1414-1433 | 2433 | GGAGACUCGGAGCCCAGCU | 2434 | GGAGAcucGGAGcccAGcudTsdT | sense |
| 1414-1433 | 2435 | AGCUGGGCUCCGAGUCUCC | 2436 | AGCUGGGCUCCGAGUCUCCdTsdT | antis |
| 1416-1435 | 2437 | AGACUCGGAGCCCAGCUCC | 2438 | AGAcucGGAGcccAGcuccdTsdT | sense |
| 1416-1435 | 2439 | GGAGCUGGGCUCCGAGUCU | 2440 | GGAGCUGGGCUCCGAGUCUdTsdT | antis |
| 1418-1437 | 2441 | ACUCGGAGCCCAGCUCCCC | 2442 | AcucGGAGcccAGcuccccdTsdT | sense |
| 1418-1437 | 2443 | GGGGAGCUGGGCUCCGAGU | 2444 | GGGGAGCUGGGCUCCGAGUdTsdT | antis |
| 1420-1439 | 2445 | UCGGAGCCCAGCUCCCCAA | 2446 | ucGGAGcccAGcuccccAAdTsdT | sense |
| 1420-1439 | 2447 | UUGGGGAGCUGGGCUCCGA | 2448 | UUGGGGAGCUGGGCUCCGAdTsdT | antis |
| 1438-1457 | 2449 | ACGACCGCCCGCUUCCCCC | 2450 | AcGAccGcccGcuuccccdTsdT | sense |
| 1438-1457 | 2451 | GGGGGAAGCGGGCGGUCGU | 2452 | GGGGGAAGCGGGCGGUCGUdTsdT | antis |
| 1447-1466 | 2453 | CGCUUCCCCCCUGUUCAA | 2454 | cGcuuccccccuGuucAAdTsdT | sense |
| 1447-1466 | 2455 | UUGAACAGGGGGGGAAGCG | 2456 | UUGAAcAGGGGGGGAAGCGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1471-1490 | 2457 | GUCCUGGUGAACUGUCCAU | 2458 | GuccuGGuGAAcuGuccAudTsdT | sense |
| 1471-1490 | 2459 | AUGGACAGUUCACCAGGAC | 2460 | AUGGAcAGUUcACcAGGACdTsdT | antis |
| 1476-1495 | 2461 | GGUGAACUGUCCAUCCAAC | 2462 | GGuGAAcuGuccAuccAAcdTsdT | sense |
| 1476-1495 | 2463 | GUUGGAUGGACAGUUCACC | 2464 | GUUGGAUGGAcAGUUcACCdTsdT | antis |
| 1477-1496 | 2465 | GUGAACUGUCCAUCCAACC | 2466 | GuGAAcuGuccAuccAAccdTsdT | sense |
| 1477-1496 | 2467 | GGUUGGAUGGACAGUUCAC | 2468 | GGUUGGAUGGAcAGUUcACdTsdT | antis |
| 1486-1505 | 2469 | CCAUCCAACCAUCUCUCAA | 2470 | ccAuccAAccAucucucAAdTsdT | sense |
| 1486-1505 | 2471 | UUGAGAGAUGGUUGGAUGG | 2472 | UUGAGAGAUGGUUGGAUGGdTsdT | antis |
| 1487-1506 | 2473 | CAUCCAACCAUCUCUCAAU | 2474 | cAuccAAccAucucucAAudTsdT | sense |
| 1487-1506 | 2475 | AUUGAGAGAUGGUUGGAUG | 2476 | AUUGAGAGAUGGUUGGAUGdTsdT | antis |
| 1491-1510 | 2477 | CAACCAUCUCUCAAUGCCA | 2478 | cAAccAucucucAAuGccAdTsdT | sense |
| 1491-1510 | 2479 | UGGCAUUGAGAGAUGGUUG | 2480 | UGGcAUUGAGAGAUGGUUGdTsdT | antis |
| 1492-1511 | 2481 | AACCAUCUCUCAAUGCCAU | 2482 | AAccAucucucAAuGccAudTsdT | sense |
| 1492-1511 | 2483 | AUGGCAUUGAGAGAUGGUU | 2484 | AUGGcAUUGAGAGAUGGUUdTsdT | antis |
| 1493-1512 | 2485 | ACCAUCUCUCAAUGCCAUU | 2486 | AccAucucucAAuGccAuudTsdT | sense |
| 1493-1512 | 2487 | AAUGGCAUUGAGAGAUGGU | 2488 | AAUGGcAUUGAGAGAUGGUdTsdT | antis |
| 1551-1570 | 2489 | UCUCCCCUCACCACUUCCU | 2490 | ucuccccucAccAcuuccudTsdT | sense |
| 1551-1570 | 2491 | AGGAAGUGGUGAGGGGAGA | 2492 | AGGAAGUGGUGAGGGGAGAdTsdT | antis |
| 1553-1572 | 2493 | UCCCCUCACCACUUCCUAC | 2494 | uccccucAccAcuuccuAcdTsdT | sense |
| 1553-1572 | 2495 | GUAGGAAGUGGUGAGGGGA | 2496 | GuAGGAAGUGGUGAGGGGAdTsdT | antis |
| 1556-1575 | 2497 | CCUCACCACUUCCUACAAC | 2498 | ccucAccAcuuccuAcAAcdTsdT | sense |
| 1556-1575 | 2499 | GUUGUAGGAAGUGGUGAGG | 2500 | GUUGuAGGAAGUGGUGAGGdTsdT | antis |
| 1560-1579 | 2501 | ACCACUUCCUACAACCCAU | 2502 | AccAcuuccuAcAAcccAudTsdT | sense |
| 1560-1579 | 2503 | AUGGGUUGUAGGAAGUGGU | 2504 | AUGGGUUGuAGGAAGUGGUdTsdT | antis |
| 1561-1580 | 2505 | CCACUUCCUACAACCCAUC | 2506 | ccAcuuccuAcAAcccAucdTsdT | sense |
| 1561-1580 | 2507 | GAUGGGUUGUAGGAAGUGG | 2508 | GAUGGGUUGuAGGAAGUGGdTsdT | antis |
| 1562-1581 | 2509 | CACUUCCUACAACCCAUCC | 2510 | cAcuuccuAcAAcccAuccdTsdT | sense |
| 1562-1581 | 2511 | GGAUGGGUUGUAGGAAGUG | 2512 | GGAUGGGUUGuAGGAAGUGdTsdT | antis |
| 1564-1583 | 2513 | CUUCCUACAACCCAUCCUC | 2514 | cuuccuAcAAcccAuccucdTsdT | sense |
| 1564-1583 | 2515 | GAGGAUGGGUUGUAGGAAG | 2516 | GAGGAUGGGUUGuAGGAAGdTsdT | antis |
| 1565-1584 | 2517 | UUCCUACAACCCAUCCUCA | 2518 | uuccuAcAAcccAuccucAdTsdT | sense |
| 1565-1584 | 2519 | UGAGGAUGGGUUGUAGGAA | 2520 | UGAGGAUGGGUUGuAGGAAdTsdT | antis |
| 1568-1587 | 2521 | CUACAACCCAUCCUCACAA | 2522 | cuAcAAcccAuccucAcAAdTsdT | sense |
| 1568-1587 | 2523 | UUGUGAGGAUGGGUUGUAG | 2524 | UUGUGAGGAUGGGUUGuAGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1569-1588 | 2525 | UACAACCCAUCCUCACAAG | 2526 | uAcAAcccAuccucAcAAGdTsdT | sense |
| 1569-1588 | 2527 | CUUGUGAGGAUGGGUUGUA | 2528 | CUUGUGAGGAUGGGUUGuAdTsdT | antis |
| 1572-1591 | 2529 | AACCCAUCCUCACAAGCUU | 2530 | AAcccAuccucAcAAGcuudTsdT | sense |
| 1572-1591 | 2531 | AAGCUUGUGAGGAUGGGUU | 2532 | AAGCUUGUGAGGAUGGGUUdTsdT | antis |
| 1573-1592 | 2533 | ACCCAUCCUCACAAGCUUU | 2534 | AcccAuccucAcAAGcuuudTsdT | sense |
| 1573-1592 | 2535 | AAAGCUUGUGAGGAUGGGU | 2536 | AAAGCUUGUGAGGAUGGGUdTsdT | antis |
| 1590-1609 | 2537 | UUAACUGAAGCUCAGACUG | 2538 | uuAAcuGAAGcucAGAcuGdTsdT | sense |
| 1590-1609 | 2539 | CAGUCUGAGCUUCAGUUAA | 2540 | cAGUCUGAGCUUcAGUuAAdTsdT | antis |
| 1591-1610 | 2541 | UAACUGAAGCUCAGACUGG | 2542 | uAAcuGAAGcucAGAcuGGdTsdT | sense |
| 1591-1610 | 2543 | CCAGUCUGAGCUUCAGUUA | 2544 | CcAGUCUGAGCUUcAGUuAdTsdT | antis |
| 1592-1611 | 2545 | AACUGAAGCUCAGACUGGC | 2546 | AAcuGAAGcucAGAcuGGcdTsdT | sense |
| 1592-1611 | 2547 | GCCAGUCUGAGCUUCAGUU | 2548 | GCcAGUCUGAGCUUcAGUUdTsdT | antis |
| 1593-1612 | 2549 | ACUGAAGCUCAGACUGGCC | 2550 | AcuGAAGcucAGAcuGGccdTsdT | sense |
| 1593-1612 | 2551 | GGCCAGUCUGAGCUUCAGU | 2552 | GGCcAGUCUGAGCUUcAGUdTsdT | antis |
| 1595-1614 | 2553 | UGAAGCUCAGACUGGCCAA | 2554 | uGAAGcucAGAcuGGccAAdTsdT | sense |
| 1595-1614 | 2555 | UUGGCCAGUCUGAGCUUCA | 2556 | UUGGCcAGUCUGAGCUUcAdTsdT | antis |
| 1601-1620 | 2557 | UCAGACUGGCCAAGAUUGG | 2558 | ucAGAcuGGccAAGAuuGGdTsdT | sense |
| 1601-1620 | 2559 | CCAAUCUUGGCCAGUCUGA | 2560 | CcAAUCUUGGCcAGUCUGAdTsdT | antis |
| 1606-1625 | 2561 | CUGGCCAAGAUUGGCAGCC | 2562 | cuGGccAAGAuuGGcAGccdTsdT | sense |
| 1606-1625 | 2563 | GGCUGCCAAUCUUGGCCAG | 2564 | GGCUGCcAAUCUUGGCcAGdTsdT | antis |
| 1610-1629 | 2565 | CCAAGAUUGGCAGCCAUCU | 2566 | ccAAGAuuGGcAGccAucudTsdT | sense |
| 1610-1629 | 2567 | AGAUGGCUGCCAAUCUUGG | 2568 | AGAUGGCUGCcAAUCUUGGdTsdT | antis |
| 1614-1633 | 2569 | GAUUGGCAGCCAUCUGAUG | 2570 | GAuuGGcAGccAucuGAuGdTsdT | sense |
| 1614-1633 | 2571 | CAUCAGAUGGCUGCCAAUC | 2572 | cAUcAGAUGGCUGCcAAUCdTsdT | antis |
| 1650-1669 | 2573 | GCUAGCUCUUCCUGAGGGC | 2574 | GcuAGcucuuccuGAGGGcdTsdT | sense |
| 1650-1669 | 2575 | GCCCUCAGGAAGAGCUAGC | 2576 | GCCCUcAGGAAGAGCuAGCdTsdT | antis |
| 1654-1673 | 2577 | GCUCUUCCUGAGGGCCCCA | 2578 | GcucuuccuGAGGGccccAdTsdT | sense |
| 1654-1673 | 2579 | UGGGGCCCUCAGGAAGAGC | 2580 | UGGGGCCCUcAGGAAGAGCdTsdT | antis |
| 1657-1676 | 2581 | CUUCCUGAGGGCCCCACCG | 2582 | cuuccuGAGGGccccAccGdTsdT | sense |
| 1657-1676 | 2583 | CGGUGGGGCCCUCAGGAAG | 2584 | CGGUGGGGCCCUcAGGAAGdTsdT | antis |
| 1799-1818 | 2585 | CAUCUAGGCCUCCCUCAGC | 2586 | cAucuAGGccucccucAGcdTsdT | sense |
| 1799-1818 | 2587 | GCUGAGGGAGGCCUAGAUG | 2588 | GCUGAGGGAGGCCuAGAUGdTsdT | antis |
| 1801-1820 | 2589 | UCUAGGCCUCCCUCAGCAG | 2590 | ucuAGGccucccucAGcAGdTsdT | sense |
| 1801-1820 | 2591 | CUGCUGAGGGAGGCCUAGA | 2592 | CUGCUGAGGGAGGCCuAGAdTsdT | antis |
| 1839-1858 | 2593 | UUUUUAAAGAGGAUUUUAA | 2594 | uuuuuAAAGAGGAuuuuAAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1839-1858 | 2595 | UUAAAAUCCUCUUUAAAAA | 2596 | UuAAAAUCCUCUUuAAAAAdTsdT | antis |
| 1840-1859 | 2597 | UUUUAAAGAGGAUUUUAAC | 2598 | uuuuAAAGAGGAuuuuAAcdTsdT | sense |
| 1840-1859 | 2599 | GUUAAAAUCCUCUUUAAAA | 2600 | GUuAAAAUCCUCUUuAAAAdTsdT | antis |
| 1841-1860 | 2601 | UUUAAAGAGGAUUUUAACU | 2602 | uuuAAAGAGGAuuuuAAcudTsdT | sense |
| 1841-1860 | 2603 | AGUUAAAAUCCUCUUUAAA | 2604 | AGUuAAAAUCCUCUUuAAAdTsdT | antis |
| 1842-1861 | 2605 | UUAAAGAGGAUUUUAACUG | 2606 | uuAAAGAGGAuuuuAAcuGdTsdT | sense |
| 1842-1861 | 2607 | CAGUUAAAAUCCUCUUUAA | 2608 | cAGUuAAAAUCCUCUUuAAdTsdT | antis |
| 1843-1862 | 2609 | UAAAGAGGAUUUUAACUGU | 2610 | uAAAGAGGAuuuuAAcuGudTsdT | sense |
| 1843-1862 | 2611 | ACAGUUAAAAUCCUCUUUA | 2612 | AcAGUuAAAAUCCUCUUuAdTsdT | antis |
| 1845-1864 | 2613 | AAGAGGAUUUUAACUGUUU | 2614 | AAGAGGAuuuuAAcuGuuudTsdT | sense |
| 1845-1864 | 2615 | AAACAGUUAAAAUCCUCUU | 2616 | AAAcAGUuAAAAUCCUCUUdTsdT | antis |
| 1849-1868 | 2617 | GGAUUUUAACUGUUUGUAG | 2618 | GGAuuuuAAcuGuuuGuAGdTsdT | sense |
| 1849-1868 | 2619 | CUACAAACAGUUAAAAUCC | 2620 | CuAcAAAcAGUuAAAAUCCdTsdT | antis |
| 1858-1877 | 2621 | CUGUUUGUAGGGGAGGGGA | 2622 | cuGuuuGuAGGGGAGGGGAdTsdT | sense |
| 1858-1877 | 2623 | UCCCCUCCCCUACAAACAG | 2624 | UCCCCUCCCCuAcAAAcAGdTsdT | antis |
| 1859-1878 | 2625 | UGUUUGUAGGGGAGGGGAG | 2626 | uGuuuGuAGGGGAGGGGAGdTsdT | sense |
| 1859-1878 | 2627 | CUCCCCUCCCCUACAAACA | 2628 | CUCCCCUCCCCuAcAAAcAdTsdT | antis |
| 1862-1881 | 2629 | UUGUAGGGGAGGGGAGAAA | 2630 | uuGuAGGGGAGGGGAGAAAdTsdT | sense |
| 1862-1881 | 2631 | UUUCUCCCCUCCCCUACAA | 2632 | UUUCUCCCCUCCCCuAcAAdTsdT | antis |
| 1863-1882 | 2633 | UGUAGGGGAGGGGAGAAAA | 2634 | uGuAGGGGAGGGGAGAAAAdTsdT | sense |
| 1863-1882 | 2635 | UUUUCUCCCCUCCCCUACA | 2636 | UUUUCUCCCCUCCCCuAcAdTsdT | antis |
| 1874-1893 | 2637 | GGAGAAAAGGAAGGACGGG | 2638 | GGAGAAAAGGAAGGAcGGGdTsdT | sense |
| 1874-1893 | 2639 | CCCGUCCUUCCUUUUCUCC | 2640 | CCCGUCCUUCCUUUUCUCCdTsdT | antis |
| 1875-1894 | 2641 | GAGAAAAGGAAGGACGGGG | 2642 | GAGAAAAGGAAGGAcGGGGdTsdT | sense |
| 1875-1894 | 2643 | CCCCGUCCUUCCUUUUCUC | 2644 | CCCCGUCCUUCCUUUUCUCdTsdT | antis |
| 1876-1895 | 2645 | AGAAAAGGAAGGACGGGGU | 2646 | AGAAAAGGAAGGAcGGGGudTsdT | sense |
| 1876-1895 | 2647 | ACCCCGUCCUUCCUUUUCU | 2648 | ACCCCGUCCUUCCUUUUCUdTsdT | antis |
| 1878-1897 | 2649 | AAAAGGAAGGACGGGGUUU | 2650 | AAAAGGAAGGAcGGGGuuudTsdT | sense |
| 1878-1897 | 2651 | AAACCCCGUCCUUCCUUUU | 2652 | AAACCCCGUCCUUCCUUUUdTsdT | antis |
| 1898-1917 | 2653 | GGGGUGUGAGGACCUUCUA | 2654 | GGGGuGuGAGGAccuucuAdTsdT | sense |
| 1898-1917 | 2655 | UAGAAGGUCCUCACACCCC | 2656 | uAGAAGGUCCUcAcACCCCdTsdT | antis |
| 1899-1918 | 2657 | GGGUGUGAGGACCUUCUAC | 2658 | GGGuGuGAGGAccuucuAcdTsdT | sense |
| 1899-1918 | 2659 | GUAGAAGGUCCUCACACCC | 2660 | GuAGAAGGUCCUcAcACCCdTsdT | antis |
| 1900-1919 | 2661 | GGUGUGAGGACCUUCUACC | 2662 | GGuGuGAGGAccuucuAccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1900-1919 | 2663 | GGUAGAAGGUCCUCACACC | 2664 | GGuAGAAGGUCCUcAcACCdTsdT | antis |
| 1902-1921 | 2665 | UGUGAGGACCUUCUACCCC | 2666 | uGuGAGGAccuucuAccccdTsdT | sense |
| 1902-1921 | 2667 | GGGGUAGAAGGUCCUCACA | 2668 | GGGGuAGAAGGUCCUcAcAdTsdT | antis |
| 1903-1922 | 2669 | GUGAGGACCUUCUACCCCC | 2670 | GuGAGGAccuucuAcccccdTsdT | sense |
| 1903-1922 | 2671 | GGGGGUAGAAGGUCCUCAC | 2672 | GGGGGuAGAAGGUCCUcACdTsdT | antis |
| 1959-1978 | 2673 | CUCCCCCCCUCUCCCAGGU | 2674 | cucccccccucucccAGGudTsdT | sense |
| 1959-1978 | 2675 | ACCUGGGAGAGGGGGGGAG | 2676 | ACCUGGGAGAGGGGGGGAGdTsdT | antis |
| 1964-1983 | 2677 | CCCCUCUCCCAGGUCCCUU | 2678 | ccccucucccAGGucccuudTsdT | sense |
| 1964-1983 | 2679 | AAGGGACCUGGGAGAGGGG | 2680 | AAGGGACCUGGGAGAGGGGdTsdT | antis |
| 1970-1989 | 2681 | UCCCAGGUCCCUUGUAAAU | 2682 | ucccAGGucccuuGuAAAudTsdT | sense |
| 1970-1989 | 2683 | AUUUACAAGGGACCUGGGA | 2684 | AUUuAcAAGGGACCUGGGAdTsdT | antis |
| 1974-1993 | 2685 | AGGUCCCUUGUAAAUAGAA | 2686 | AGGucccuuGuAAAuAGAAdTsdT | sense |
| 1974-1993 | 2687 | UUCUAUUUACAAGGGACCU | 2688 | UUCuAUUuAcAAGGGACCUdTsdT | antis |
| 1983-2002 | 2689 | GUAAAUAGAACCAGCCCAG | 2690 | GuAAAuAGAAccAGcccAGdTsdT | sense |
| 1983-2002 | 2691 | CUGGGCUGGUUCUAUUUAC | 2692 | CUGGGCUGGUUCuAUUuACdTsdT | antis |
| 1984-2003 | 2693 | UAAAUAGAACCAGCCCAGC | 2694 | uAAAuAGAAccAGcccAGcdTsdT | sense |
| 1984-2003 | 2695 | GCUGGGCUGGUUCUAUUUA | 2696 | GCUGGGCUGGUUCuAUUuAdTsdT | antis |
| 1994-2013 | 2697 | CAGCCCAGCCCAUCUCUCG | 2698 | cAGcccAGcccAucucucGdTsdT | sense |
| 1994-2013 | 2699 | CGAGAGAUGGGCUGGGCUG | 2700 | CGAGAGAUGGGCUGGGCUGdTsdT | antis |
| 1995-2014 | 2701 | AGCCCAGCCCAUCUCUCGU | 2702 | AGcccAGcccAucucucGudTsdT | sense |
| 1995-2014 | 2703 | ACGAGAGAUGGGCUGGGCU | 2704 | ACGAGAGAUGGGCUGGGCUdTsdT | antis |
| 1996-2015 | 2705 | GCCCAGCCCAUCUCUCGUC | 2706 | GcccAGcccAucucucGucdTsdT | sense |
| 1996-2015 | 2707 | GACGAGAGAUGGGCUGGGC | 2708 | GACGAGAGAUGGGCUGGGCdTsdT | antis |
| 1998-2017 | 2709 | CCAGCCCAUCUCUCGUCUU | 2710 | ccAGcccAucucucGucuudTsdT | sense |
| 1998-2017 | 2711 | AAGACGAGAGAUGGGCUGG | 2712 | AAGACGAGAGAUGGGCUGGdTsdT | antis |
| 2016-2035 | 2713 | UCCCUUCCCUGGCCCCCUG | 2714 | ucccuucccuGGcccccuGdTsdT | sense |
| 2016-2035 | 2715 | CAGGGGGCCAGGGAAGGGA | 2716 | cAGGGGGCcAGGGAAGGGAdTsdT | antis |
| 2022-2041 | 2717 | CCCUGGCCCCCUGGGUGUA | 2718 | cccuGGcccccuGGGuGuAdTsdT | sense |
| 2022-2041 | 2719 | UACACCCAGGGGGCCAGGG | 2720 | uAcACCcAGGGGGCcAGGGdTsdT | antis |
| 2025-2044 | 2721 | UGGCCCCCUGGGUGUAAAU | 2722 | uGGcccccuGGGuGuAAAudTsdT | sense |
| 2025-2044 | 2723 | AUUUACACCCAGGGGGCCA | 2724 | AUUuAcACCcAGGGGGCcAdTsdT | antis |
| 2026-2045 | 2725 | GGCCCCCUGGGUGUAAAUA | 2726 | GGcccccuGGGuGuAAAuAdTsdT | sense |
| 2026-2045 | 2727 | UAUUUACACCCAGGGGGCC | 2728 | uAUUuAcACCcAGGGGGCCdTsdT | antis |
| 2035-2054 | 2729 | GGUGUAAAUAGAUUGUUAU | 2730 | GGuGuAAAuAGAuuGuuAudTsdT | sense |
| 2035-2054 | 2731 | AUAACAAUCUAUUUACACC | 2732 | AuAAcAAUCuAUUuAcACCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2041-2060 | 2733 | AAUAGAUUGUUAUAAUUUU | 2734 | AAuAGAuuGuuAuAAuuuudTsdT | sense |
| 2041-2060 | 2735 | AAAAUUAUAACAAUCUAUU | 2736 | AAAAUuAuAAcAAUCuAUUdTsdT | antis |
| 2047-2066 | 2737 | UUGUUAUAAUUUUUUCUUA | 2738 | uuGuuAuAAuuuuuucuuAdTsdT | sense |
| 2047-2066 | 2739 | UAAGAAAAAAUUAUAACAA | 2740 | uAAGAAAAAAUuAuAAcAAdTsdT | antis |
| 2057-2076 | 2741 | UUUUUCUUAAAGAAAACGU | 2742 | uuuuucuuAAAGAAAAcGudTsdT | sense |
| 2057-2076 | 2743 | ACGUUUUCUUUAAGAAAAA | 2744 | ACGUUUUCUUuAAGAAAAAdTsdT | antis |
| 2058-2077 | 2745 | UUUUCUUAAAGAAAACGUC | 2746 | uuuucuuAAAGAAAAcGucdTsdT | sense |
| 2058-2077 | 2747 | GACGUUUUCUUUAAGAAAA | 2748 | GACGUUUUCUUuAAGAAAAdTsdT | antis |
| 2060-2079 | 2749 | UUCUUAAAGAAAACGUCAA | 2750 | uucuuAAAGAAAAcGucAAdTsdT | sense |
| 2060-2079 | 2751 | UUGACGUUUUCUUUAAGAA | 2752 | UUGACGUUUUCUUuAAGAAdTsdT | antis |
| 2066-2085 | 2753 | AAGAAAACGUCAAUUCACA | 2754 | AAGAAAAcGucAAuucAcAdTsdT | sense |
| 2066-2085 | 2755 | UGUGAAUUGACGUUUUCUU | 2756 | UGUGAAUUGACGUUUUCUUdTsdT | antis |
| 2075-2094 | 2757 | UCAAUUCACACCAUUCAAC | 2758 | ucAAuucAcAccAuucAAcdTsdT | sense |
| 2075-2094 | 2759 | GUUGAAUGGUGUGAAUUGA | 2760 | GUUGAAUGGUGUGAAUUGAdTsdT | antis |
| 2077-2096 | 2761 | AAUUCACACCAUUCAACUU | 2762 | AAuucAcAccAuucAAcuudTsdT | sense |
| 2077-2096 | 2763 | AAGUUGAAUGGUGUGAAUU | 2764 | AAGUUGAAUGGUGUGAAUUdTsdT | antis |
| 2079-2098 | 2765 | UUCACACCAUUCAACUUGC | 2766 | uucAcAccAuucAAcuuGcdTsdT | sense |
| 2079-2098 | 2767 | GCAAGUUGAAUGGUGUGAA | 2768 | GcAAGUUGAAUGGUGUGAAdTsdT | antis |
| 2081-2100 | 2769 | CACACCAUUCAACUUGCCC | 2770 | cAcAccAuucAAcuuGcccdTsdT | sense |
| 2081-2100 | 2771 | GGGCAAGUUGAAUGGUGUG | 2772 | GGGcAAGUUGAAUGGUGUGdTsdT | antis |
| 2091-2110 | 2773 | AACUUGCCCCCCCCAGCUG | 2774 | AAcuuGccccccccAGcuGdTsdT | sense |
| 2091-2110 | 2775 | CAGCUGGGGGGGGCAAGUU | 2776 | cAGCUGGGGGGGGcAAGUUdTsdT | antis |
| 2092-2111 | 2777 | ACUUGCCCCCCCCAGCUGU | 2778 | AcuuGccccccccAGcuGudTsdT | sense |
| 2092-2111 | 2779 | ACAGCUGGGGGGGGCAAGU | 2780 | AcAGCUGGGGGGGGcAAGUdTsdT | antis |
| 2096-2115 | 2781 | GCCCCCCCCAGCUGUACCC | 2782 | GccccccccAGcuGuAcccdTsdT | sense |
| 2096-2115 | 2783 | GGGUACAGCUGGGGGGGGC | 2784 | GGGuAcAGCUGGGGGGGGCdTsdT | antis |
| 2097-2116 | 2785 | CCCCCCCCAGCUGUACCCC | 2786 | ccccccccAGcuGuAccccdTsdT | sense |
| 2097-2116 | 2787 | GGGGUACAGCUGGGGGGGG | 2788 | GGGGuAcAGCUGGGGGGGGdTsdT | antis |
| 2098-2117 | 2789 | CCCCCCCAGCUGUACCCCU | 2790 | cccccccAGcuGuAccccudTsdT | sense |
| 2098-2117 | 2791 | AGGGGUACAGCUGGGGGGG | 2792 | AGGGGuAcAGCUGGGGGGGdTsdT | antis |
| 2099-2118 | 2793 | CCCCCCAGCUGUACCCCUU | 2794 | ccccccAGcuGuAccccuudTsdT | sense |
| 2099-2118 | 2795 | AAGGGGUACAGCUGGGGGG | 2796 | AAGGGGuAcAGCUGGGGGGdTsdT | antis |
| 2100-2119 | 2797 | CCCCCAGCUGUACCCCUUC | 2798 | cccccAGcuGuAccccuucdTsdT | sense |
| 2100-2119 | 2799 | GAAGGGGUACAGCUGGGGG | 2800 | GAAGGGGuAcAGCUGGGGGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2107-2126 | 2801 | CUGUACCCCUUCUUGUCCU | 2802 | cuGuAccccuucuuGuccudTsdT | sense |
| 2107-2126 | 2803 | AGGACAAGAAGGGGUACAG | 2804 | AGGAcAAGAAGGGGuAcAGdTsdT | antis |
| 2108-2127 | 2805 | UGUACCCCUUCUUGUCCUC | 2806 | uGuAccccuucuuGuccucdTsdT | sense |
| 2108-2127 | 2807 | GAGGACAAGAAGGGGUACA | 2808 | GAGGAcAAGAAGGGGuAcAdTsdT | antis |
| 2123-2142 | 2809 | CCUCUGCUCCCAAGGCUUC | 2810 | ccucuGcucccAAGGcuucdTsdT | sense |
| 2123-2142 | 2811 | GAAGCCUUGGGAGCAGAGG | 2812 | GAAGCCUUGGGAGcAGAGGdTsdT | antis |
| 2124-2143 | 2813 | CUCUGCUCCCAAGGCUUCC | 2814 | cucuGcucccAAGGcuuccdTsdT | sense |
| 2124-2143 | 2815 | GGAAGCCUUGGGAGCAGAG | 2816 | GGAAGCCUUGGGAGcAGAGdTsdT | antis |
| 2151-2170 | 2817 | CCCAUCCUGGAAGGAGGGG | 2818 | cccAuccuGGAAGGAGGGGdTsdT | sense |
| 2151-2170 | 2819 | CCCCUCCUUCCAGGAUGGG | 2820 | CCCCUCCUUCcAGGAUGGGdTsdT | antis |
| 2157-2176 | 2821 | CUGGAAGGAGGGGAGUAGA | 2822 | cuGGAAGGAGGGGAGuAGAdTsdT | sense |
| 2157-2176 | 2823 | UCUACUCCCCUCCUUCCAG | 2824 | UCuACUCCCCUCCUUCcAGdTsdT | antis |
| 2158-2177 | 2825 | UGGAAGGAGGGGAGUAGAG | 2826 | uGGAAGGAGGGGAGuAGAGdTsdT | sense |
| 2158-2177 | 2827 | CUCUACUCCCCUCCUUCCA | 2828 | CUCuACUCCCCUCCUUCcAdTsdT | antis |
| 2159-2178 | 2829 | GGAAGGAGGGGAGUAGAGA | 2830 | GGAAGGAGGGGAGuAGAGAdTsdT | sense |
| 2159-2178 | 2831 | UCUCUACUCCCCUCCUUCC | 2832 | UCUCuACUCCCCUCCUUCCdTsdT | antis |
| 2160-2179 | 2833 | GAAGGAGGGGAGUAGAGAG | 2834 | GAAGGAGGGGAGuAGAGAGdTsdT | sense |
| 2160-2179 | 2835 | CUCUCUACUCCCCUCCUUC | 2836 | CUCUCuACUCCCCUCCUUCdTsdT | antis |
| 2165-2184 | 2837 | AGGGGAGUAGAGAGAGUCC | 2838 | AGGGGAGuAGAGAGAGuccdTsdT | sense |
| 2165-2184 | 2839 | GGACUCUCUCUACUCCCCU | 2840 | GGACUCUCUCuACUCCCCUdTsdT | antis |
| 2166-2185 | 2841 | GGGGAGUAGAGAGAGUCCC | 2842 | GGGGAGuAGAGAGAGucccdTsdT | sense |
| 2166-2185 | 2843 | GGGACUCUCUCUACUCCCC | 2844 | GGGACUCUCUCuACUCCCCdTsdT | antis |
| 2169-2188 | 2845 | GAGUAGAGAGAGUCCCUGG | 2846 | GAGuAGAGAGAGucccuGGdTsdT | sense |
| 2169-2188 | 2847 | CCAGGGACUCUCUCUACUC | 2848 | CcAGGGACUCUCUCuACUCdTsdT | antis |
| 2173-2192 | 2849 | AGAGAGAGUCCCUGGUGUC | 2850 | AGAGAGAGucccuGGuGucdTsdT | sense |
| 2173-2192 | 2851 | GACACCAGGGACUCUCUCU | 2852 | GAcACcAGGGACUCUCUCUdTsdT | antis |
| 2178-2197 | 2853 | GAGUCCCUGGUGUCUUAGU | 2854 | GAGucccuGGuGucuuAGudTsdT | sense |
| 2178-2197 | 2855 | ACUAAGACACCAGGGACUC | 2856 | ACuAAGAcACcAGGGACUCdTsdT | antis |
| 2179-2198 | 2857 | AGUCCCUGGUGUCUUAGUU | 2858 | AGucccuGGuGucuuAGuudTsdT | sense |
| 2179-2198 | 2859 | AACUAAGACACCAGGGACU | 2860 | AACuAAGAcACcAGGGACUdTsdT | antis |
| 2182-2201 | 2861 | CCCUGGUGUCUUAGUUUCC | 2862 | cccuGGuGucuuAGuuuccdTsdT | sense |
| 2182-2201 | 2863 | GGAAACUAAGACACCAGGG | 2864 | GGAAACuAAGAcACcAGGGdTsdT | antis |
| 2183-2202 | 2865 | CCUGGUGUCUUAGUUUCCA | 2866 | ccuGGuGucuuAGuuuccAdTsdT | sense |
| 2183-2202 | 2867 | UGGAAACUAAGACACCAGG | 2868 | UGGAAACuAAGAcACcAGGdTsdT | antis |
| 2188-2207 | 2869 | UGUCUUAGUUUCCACAGUA | 2870 | uGucuuAGuuuccAcAGuAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2188-2207 | 2871 | UACUGUGGAAACUAAGACA | 2872 | uACUGUGGAAACuAAGAcAdTsdT | antis |
| 2198-2217 | 2873 | UCCACAGUAAGGUUUGCCU | 2874 | uccAcAGuAAGGuuuGccudTsdT | sense |
| 2198-2217 | 2875 | AGGCAAACCUUACUGUGGA | 2876 | AGGcAAACCUuACUGUGGAdTsdT | antis |
| 2199-2218 | 2877 | CCACAGUAAGGUUUGCCUG | 2878 | ccAcAGuAAGGuuuGccuGdTsdT | sense |
| 2199-2218 | 2879 | CAGGCAAACCUUACUGUGG | 2880 | cAGGcAAACCUuACUGUGGdTsdT | antis |
| 2200-2219 | 2881 | CACAGUAAGGUUUGCCUGU | 2882 | cAcAGuAAGGuuuGccuGudTsdT | sense |
| 2200-2219 | 2883 | ACAGGCAAACCUUACUGUG | 2884 | AcAGGcAAACCUuACUGUGdTsdT | antis |
| 2201-2220 | 2885 | ACAGUAAGGUUUGCCUGUG | 2886 | AcAGuAAGGuuuGccuGuGdTsdT | sense |
| 2201-2220 | 2887 | CACAGGCAAACCUUACUGU | 2888 | cAcAGGcAAACCUuACUGUdTsdT | antis |
| 2203-2222 | 2889 | AGUAAGGUUUGCCUGUGUA | 2890 | AGuAAGGuuuGccuGuGuAdTsdT | sense |
| 2203-2222 | 2891 | UACACAGGCAAACCUUACU | 2892 | uAcAcAGGcAAACCUuACUdTsdT | antis |
| 2204-2223 | 2893 | GUAAGGUUUGCCUGUGUAC | 2894 | GuAAGGuuuGccuGuGuAcdTsdT | sense |
| 2204-2223 | 2895 | GUACACAGGCAAACCUUAC | 2896 | GuAcAcAGGcAAACCUuACdTsdT | antis |
| 2205-2224 | 2897 | UAAGGUUUGCCUGUGUACA | 2898 | uAAGGuuuGccuGuGuAcAdTsdT | sense |
| 2205-2224 | 2899 | UGUACACAGGCAAACCUUA | 2900 | UGuAcAcAGGcAAACCUuAdTsdT | antis |
| 2210-2229 | 2901 | UUUGCCUGUGUACAGACCU | 2902 | uuuGccuGuGuAcAGAccudTsdT | sense |
| 2210-2229 | 2903 | AGGUCUGUACACAGGCAAA | 2904 | AGGUCUGuAcAcAGGcAAAdTsdT | antis |
| 2211-2230 | 2905 | UUGCCUGUGUACAGACCUC | 2906 | uuGccuGuGuAcAGAccucdTsdT | sense |
| 2211-2230 | 2907 | GAGGUCUGUACACAGGCAA | 2908 | GAGGUCUGuAcAcAGGcAAdTsdT | antis |
| 2214-2233 | 2909 | CCUGUGUACAGACCUCUGU | 2910 | ccuGuGuAcAGAccucuGudTsdT | sense |
| 2214-2233 | 2911 | ACAGAGGUCUGUACACAGG | 2912 | AcAGAGGUCUGuAcAcAGGdTsdT | antis |
| 2215-2234 | 2913 | CUGUGUACAGACCUCUGUU | 2914 | cuGuGuAcAGAccucuGuudTsdT | sense |
| 2215-2234 | 2915 | AACAGAGGUCUGUACACAG | 2916 | AAcAGAGGUCUGuAcAcAGdTsdT | antis |
| 2220-2239 | 2917 | UACAGACCUCUGUUCAAUA | 2918 | uAcAGAccucuGuucAAuAdTsdT | sense |
| 2220-2239 | 2919 | UAUUGAACAGAGGUCUGUA | 2920 | uAUUGAAcAGAGGUCUGuAdTsdT | antis |
| 2224-2243 | 2921 | GACCUCUGUUCAAUAAAUU | 2922 | GAccucuGuucAAuAAAuudTsdT | sense |
| 2224-2243 | 2923 | AAUUUAUUGAACAGAGGUC | 2924 | AAUUuAUUGAAcAGAGGUCdTsdT | antis |
| 2234-2253 | 2925 | CAAUAAAUUAUUGGCAUGA | 2926 | cAAuAAAuuAuuGGcAuGAdTsdT | sense |
| 2234-2253 | 2927 | UCAUGCCAAUAAUUUAUUG | 2928 | UcAUGCcAAuAAUUuAUUGdTsdT | antis |
| 51-70 | 2929 | CGCGGCGGGCGCUGGGCCG | 2930 | cGcGGcGGGcGcuGGGccGdTsdT | sense |
| 51-70 | 2931 | CGGCCCAGCGCCCGCCGCG | 2932 | CGGCCcAGCGCCCGCCGCGdTsdT | antis |
| 173-192 | 2933 | UGGGCCUGCGCUCGGCGCC | 2934 | uGGGccuGcGcucGGcGccdTsdT | sense |
| 173-192 | 2935 | GGCGCCGAGCGCAGGCCCA | 2936 | GGCGCCGAGCGCAGGCCcAdTsdT | antis |
| 205-224 | 2937 | GGCCUUCGGGAGGCGGCCC | 2938 | GGccuucGGGAGGcGGcccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 205-224 | 2939 | GGGCCGCCUCCCGAAGGCC | 2940 | GGGCCGCCUCCCGAAGGCCdTsdT | antis |
| 221-240 | 2941 | CCCUGGGGGCUCGGGCCGG | 2942 | cccuGGGGGcucGGGccGGGdTsdT | sense |
| 221-240 | 2943 | CCGGCCCGAGCCCCCAGGG | 2944 | CCGGCCCGAGCCCCcAGGGdTsdT | antis |
| 224-243 | 2945 | UGGGGGCUCGGGCCGGGCG | 2946 | uGGGGGcucGGGccGGGcGdTsdT | sense |
| 224-243 | 2947 | CGCCCGGCCCGAGCCCCCA | 2948 | CGCCCGGCCCGAGCCCCcAdTsdT | antis |
| 387-406 | 2949 | GGGGGUGGCCCCAGCGGCA | 2950 | GGGGGuGGccccAGcGGcAdTsdT | sense |
| 387-406 | 2951 | UGCCGCUGGGGCCACCCCC | 2952 | UGCCGCUGGGGCcACCCCCdTsdT | antis |
| 392-411 | 2953 | UGGCCCCAGCGGCAGCGGC | 2954 | uGGccccAGcGGcAGcGGcdTsdT | sense |
| 392-411 | 2955 | GCCGCUGCCGCUGGGGCCA | 2956 | GCCGCUGCCGCUGGGGCcAdTsdT | antis |
| 465-484 | 2957 | AAGCUGGGCCGUGACAGCG | 2958 | AAGcuGGGccGuGAcAGcGdTsdT | sense |
| 465-484 | 2959 | CGCUGUCACGGCCCAGCUU | 2960 | CGCUGUcACGGCCcAGCUUdTsdT | antis |
| 505-524 | 2961 | CCACUGUAGGCCAAGGCCC | 2962 | ccAcuGuAGGccAAGGcccdTsdT | sense |
| 505-524 | 2963 | GGGCCUUGGCCUACAGUGG | 2964 | GGGCCUUGGCCuAcAGUGGdTsdT | antis |
| 587-606 | 2965 | AGUAUACCAGGCACGGCUG | 2966 | AGuAuAccAGGcAcGGcuGdTsdT | sense |
| 587-606 | 2967 | CAGCCGUGCCUGGUAUACU | 2968 | cAGCCGUGCCUGGuAuACUdTsdT | antis |
| 601-620 | 2969 | GGCUGGCAGAGACGAGGGA | 2970 | GGcuGGcAGAGAcGAGGGAdTsdT | sense |
| 601-620 | 2971 | UCCCUCGUCUCUGCCAGCC | 2972 | UCCCUCGUCUCUGCcAGCCdTsdT | antis |
| 743-762 | 2973 | GAAGAAGGACGAGCUGUAU | 2974 | GAAGAAGGAcGAGcuGuAudTsdT | sense |
| 743-762 | 2975 | AUACAGCUCGUCCUUCUUC | 2976 | AuAcAGCUCGUCCUUCUUCdTsdT | antis |
| 927-946 | 2977 | AAGCCCCAGAAUUUGCUUG | 2978 | AAGccccAGAAuuuGcuuGdTsdT | sense |
| 927-946 | 2979 | CAAGCAAAUUCUGGGGCUU | 2980 | cAAGcAAAUUCUGGGGCUUdTsdT | antis |
| 932-951 | 2981 | CCAGAAUUUGCUUGUGGAC | 2982 | ccAGAAuuuGcuuGuGGAcdTsdT | sense |
| 932-951 | 2983 | GUCCACAAGCAAAUUCUGG | 2984 | GUCcAcAAGcAAAUUCUGGdTsdT | antis |
| 1054-1073 | 2985 | CAGAACUCAUCUUUGGAGC | 2986 | cAGAAcucAucuuuGGAGcdTsdT | sense |
| 1054-1073 | 2987 | GCUCCAAAGAUGAGUUCUG | 2988 | GCUCcAAAGAUGAGUUCUGdTsdT | antis |
| 1060-1079 | 2989 | UCAUCUUUGGAGCCACAGA | 2990 | ucAucuuuGGAGccAcAGAdTsdT | sense |
| 1060-1079 | 2991 | UCUGUGGCUCCAAAGAUGA | 2992 | UCUGUGGCUCcAAAGAUGAdTsdT | antis |
| 1068-1087 | 2993 | GGAGCCACAGAUUACACCU | 2994 | GGAGccAcAGAuuAcAccudTsdT | sense |
| 1068-1087 | 2995 | AGGUGUAAUCUGUGGCUCC | 2996 | AGGUGuAAUCUGUGGCUCCdTsdT | antis |
| 1094-1113 | 2997 | CGAUGUGGUCGGCUGGC | 2998 | cGAuGuGGucGGcuGGcdTsdT | sense |
| 1094-1113 | 2999 | GCCAGCCGACCACACAUCG | 3000 | GCcAGCCGACcAcAcAUCGdTsdT | antis |
| 1107-1126 | 3001 | GCUGGCUGUGUACUUGCUG | 3002 | GcuGGcuGuGuAcuuGcuGdTsdT | sense |
| 1107-1126 | 3003 | CAGCAAGUACACAGCCAGC | 3004 | cAGcAAGuAcAcAGCcAGCdTsdT | antis |
| 1108-1127 | 3005 | CUGGCUGUGUACUUGCUGA | 3006 | cuGGcuGuGuAcuuGcuGAdTsdT | sense |
| 1108-1127 | 3007 | UCAGCAAGUACACAGCCAG | 3008 | UcAGcAAGuAcAcAGCcAGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1138-1157 | 3009 | GCCAGCCCAUCUUCCCUGG | 3010 | GccAGcccAucuucccuGGdTsdT | sense |
| 1138-1157 | 3011 | CCAGGGAAGAUGGGCUGGC | 3012 | CcAGGGAAGAUGGGCUGGCdTsdT | antis |
| 1149-1168 | 3013 | UUCCCUGGGGACAGUGGGG | 3014 | uucccuGGGGAcAGuGGGGdTsdT | sense |
| 1149-1168 | 3015 | CCCCACUGUCCCCAGGGAA | 3016 | CCCcACUGUCCCcAGGGAAdTsdT | antis |
| 1474-1493 | 3017 | CUGGUGAACUGUCCAUCCA | 3018 | cuGGuGAAcuGuccAuccAdTsdT | sense |
| 1474-1493 | 3019 | UGGAUGGACAGUUCACCAG | 3020 | UGGAUGGAcAGUUcACcAGdTsdT | antis |
| 1480-1499 | 3021 | AACUGUCCAUCCAACCAUC | 3022 | AAcuGuccAuccAAccAucdTsdT | sense |
| 1480-1499 | 3023 | GAUGGUUGGAUGGACAGUU | 3024 | GAUGGUUGGAUGGAcAGUUdTsdT | antis |
| 1555-1574 | 3025 | CCCUCACCACUUCCUACAA | 3026 | cccucAccAcuuccuAcAAdTsdT | sense |
| 1555-1574 | 3027 | UUGUAGGAAGUGGUGAGGG | 3028 | UUGuAGGAAGUGGUGAGGGdTsdT | antis |
| 1848-1867 | 3029 | AGGAUUUUAACUGUUUGUA | 3030 | AGGAuuuuAAcuGuuuGuAdTsdT | sense |
| 1848-1867 | 3031 | UACAAACAGUUAAAAUCCU | 3032 | uAcAAAcAGUuAAAAUCCUdTsdT | antis |
| 2031-2050 | 3033 | CCUGGGUGUAAAUAGAUUG | 3034 | ccuGGGuGuAAAuAGAuuGdTsdT | sense |
| 2031-2050 | 3035 | CAAUCUAUUUACACCCAGG | 3036 | cAAUCuAUUuAcACCcAGGdTsdT | antis |
| 2042-2061 | 3037 | AUAGAUUGUUAUAAUUUUU | 3038 | AuAGAuuGuuAuAAuuuuudTsdT | sense |
| 2042-2061 | 3039 | AAAAAUUAUAACAAUCUAU | 3040 | AAAAAUuAuAAcAAUCuAUdTsdT | antis |
| 2127-2146 | 3041 | UGCUCCCAAGGCUUCCUCC | 3042 | uGcucccAAGGcuuccuccdTsdT | sense |
| 2127-2146 | 3043 | GGAGGAAGCCUUGGGAGCA | 3044 | GGAGGAAGCCUUGGGAGcAdTsdT | antis |
| 2230-2249 | 3045 | UGUUCAAUAAAUUAUUGGC | 3046 | uGuucAAuAAAuuAuuGGcdTsdT | sense |
| 2230-2249 | 3047 | GCCAAUAAUUUAUUGAACA | 3048 | GCcAAuAAUUuAUUGAAcAdTsdT | antis |
| 48-67 | 3049 | CCCCGCGGCGGGCGCUGGG | 3050 | ccccGcGGcGGGcGcuGGGdTsdT | sense |
| 48-67 | 3051 | CCCAGCGCCCGCCGCGGGG | 3052 | CCcAGCGCCCGCCGCGGGGdTsdT | antis |
| 50-69 | 3053 | CCGCGGCGGGCGCUGGGCC | 3054 | ccGcGGcGGGcGcuGGGccdTsdT | sense |
| 50-69 | 3055 | GGCCCAGCGCCCGCCGCGG | 3056 | GGCCcAGCGCCCGCCGCGGdTsdT | antis |
| 56-75 | 3057 | CGGGCGCUGGGCCGGAGCC | 3058 | cGGGcGcuGGGccGGAGccdTsdT | sense |
| 56-75 | 3059 | GGCUCCGGCCCAGCGCCCG | 3060 | GGCUCCGGCCcAGCGCCCGdTsdT | antis |
| 89-108 | 3061 | GCGGCCUGGAAGAGGCCGG | 3062 | GcGGccuGGAAGAGGccGGdTsdT | sense |
| 89-108 | 3063 | CCGGCCUCUUCCAGGCCGC | 3064 | CCGGCCUCUUCcAGGCCGCdTsdT | antis |
| 91-110 | 3065 | GGCCUGGAAGAGGCCGGAG | 3066 | GGccuGGAAGAGGccGGAGdTsdT | sense |
| 91-110 | 3067 | CUCCGGCCUCUUCCAGGCC | 3068 | CUCCGGCCUCUUCcAGGCCdTsdT | antis |
| 95-114 | 3069 | UGGAAGAGGCCGGAGCCCA | 3070 | uGGAAGAGGccGGAGcccAdTsdT | sense |
| 95-114 | 3071 | UGGGCUCCGGCCUCUUCCA | 3072 | UGGGCUCCGGCCUCUUCcAdTsdT | antis |
| 96-115 | 3073 | GGAAGAGGCCGGAGCCCAG | 3074 | GGAAGAGGccGGAGcccAGdTsdT | sense |
| 96-115 | 3075 | CUGGGCUCCGGCCUCUUCC | 3076 | CUGGGCUCCGGCCUCUUCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 103-122 | 3077 | GCCGGAGCCCAGGGGAGGC | 3078 | GccGGAGcccAGGGGAGGcdTsdT | sense |
| 103-122 | 3079 | GCCUCCCCUGGGCUCCGGC | 3080 | GCCUCCCCUGGGCUCCGGCdTsdT | antis |
| 104-123 | 3081 | CCGGAGCCCAGGGGAGGCG | 3082 | ccGGAGcccAGGGGAGGcGdTsdT | sense |
| 104-123 | 3083 | CGCCUCCCCUGGGCUCCGG | 3084 | CGCCUCCCCUGGGCUCCGGdTsdT | antis |
| 105-124 | 3085 | CGGAGCCCAGGGGAGGCGG | 3086 | cGGAGcccAGGGGAGGcGGdTsdT | sense |
| 105-124 | 3087 | CCGCCUCCCCUGGGCUCCG | 3088 | CCGCCUCCCCUGGGCUCCGdTsdT | antis |
| 134-153 | 3089 | AGCGGCGGGGGCAGCCCAG | 3090 | AGcGGcGGGGGcAGcccAGdTsdT | sense |
| 134-153 | 3091 | CUGGGCUGCCCCCGCCGCU | 3092 | CUGGGCUGCCCCCGCCGCUdTsdT | antis |
| 147-166 | 3093 | GCCCAGGCAGCCCGAGCCC | 3094 | GcccAGGcAGcccGAGcccdTsdT | sense |
| 147-166 | 3095 | GGGCUCGGGCUGCCUGGGC | 3096 | GGGCUCGGGCUGCCUGGGCdTsdT | antis |
| 158-177 | 3097 | CCGAGCCCCGCGGCCUGGG | 3098 | ccGAGccccGcGGccuGGGdTsdT | sense |
| 158-177 | 3099 | CCCAGGCCGCGGGGCUCGG | 3100 | CCcAGGCCGCGGGGCUCGGdTsdT | antis |
| 167-186 | 3101 | GCGGCCUGGGCCUGCGCUC | 3102 | GcGGccuGGGccuGcGcucdTsdT | sense |
| 167-186 | 3103 | GAGCGCAGGCCCAGGCCGC | 3104 | GAGCGcAGGCCcAGGCCGCdTsdT | antis |
| 172-191 | 3105 | CUGGGCCUGCGCUCGGCGC | 3106 | cuGGGccuGcGcucGGcGcdTsdT | sense |
| 172-191 | 3107 | GCGCCGAGCGCAGGCCCAG | 3108 | GCGCCGAGCGcAGGCCcAGdTsdT | antis |
| 204-223 | 3109 | GGGCCUUCGGGAGGCGGCC | 3110 | GGGccuucGGGAGGcGGccdTsdT | sense |
| 204-223 | 3111 | GGCCGCCUCCCGAAGGCCC | 3112 | GGCCGCCUCCCGAAGGCCCdTsdT | antis |
| 209-228 | 3113 | UUCGGGAGGCGGCCCUGGG | 3114 | uucGGGAGGcGGcccuGGGdTsdT | sense |
| 209-228 | 3115 | CCCAGGGCCGCCUCCCGAA | 3116 | CCcAGGGCCGCCUCCCGAAdTsdT | antis |
| 231-250 | 3117 | UCGGGCCGGGCGCGGACCA | 3118 | ucGGGccGGGcGcGGAccAdTsdT | sense |
| 231-250 | 3119 | UGGUCCGCGCCCGGCCCGA | 3120 | UGGUCCGCGCCCGGCCCGAdTsdT | antis |
| 256-275 | 3121 | UCGCGGAGCCAGGAGGCGG | 3122 | ucGcGGAGccAGGAGGcGGdTsdT | sense |
| 256-275 | 3123 | CCGCCUCCUGGCUCCGCGA | 3124 | CCGCCUCCUGGCUCCGCGAdTsdT | antis |
| 294-313 | 3125 | GGCCCCGGGGGCUCGGCCU | 3126 | GGccccGGGGGcucGGccudTsdT | sense |
| 294-313 | 3127 | AGGCCGAGCCCCCGGGGCC | 3128 | AGGCCGAGCCCCCGGGGCCdTsdT | antis |
| 295-314 | 3129 | GCCCCGGGGCUCGGCCUC | 3130 | GccccGGGGGcucGGccucdTsdT | sense |
| 295-314 | 3131 | GAGGCCGAGCCCCCGGGGC | 3132 | GAGGCCGAGCCCCCGGGGCdTsdT | antis |
| 318-337 | 3133 | CCAGGAGGCACUGGCGGCG | 3134 | ccAGGAGGcAcuGGcGGcGdTsdT | sense |
| 318-337 | 3135 | CGCCGCCAGUGCCUCCUGG | 3136 | CGCCGCcAGUGCCUCCUGGdTsdT | antis |
| 369-388 | 3137 | GUGGGAGCCUCGAGCUCCG | 3138 | GuGGGAGccucGAGcuccGdTsdT | sense |
| 369-388 | 3139 | CGGAGCUCGAGGCUCCCAC | 3140 | CGGAGCUCGAGGCUCCcACdTsdT | antis |
| 386-405 | 3141 | CGGGGGUGGCCCCAGCGGC | 3142 | cGGGGGuGGccccAGcGGcdTsdT | sense |
| 386-405 | 3143 | GCCGCUGGGGCCACCCCCG | 3144 | GCCGCUGGGGCcACCCCCGdTsdT | antis |
| 390-409 | 3145 | GGUGGCCCCAGCGGCAGCG | 3146 | GGuGGccccAGcGGcAGcGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 390-409 | 3147 | CGCUGCCGCUGGGGCCACC | 3148 | CGCUGCCGCUGGGGCcACCdTsdT | antis |
| 391-410 | 3149 | GUGGCCCCAGCGGCAGCGG | 3150 | GuGGccccAGcGGcAGcGGdTsdT | sense |
| 391-410 | 3151 | CCGCUGCCGCUGGGGCCAC | 3152 | CCGCUGCCGCUGGGGCcACdTsdT | antis |
| 460-479 | 3153 | GAGUGAAGCUGGGCCGUGA | 3154 | GAGuGAAGcuGGGccGuGAdTsdT | sense |
| 460-479 | 3155 | UCACGGCCCAGCUUCACUC | 3156 | UcACGGCCcAGCUUcACUCdTsdT | antis |
| 491-510 | 3157 | GACCACAGUGGUAGCCACU | 3158 | GAccAcAGuGGuAGccAcudTsdT | sense |
| 491-510 | 3159 | AGUGGCUACCACUGUGGUC | 3160 | AGUGGCuAccACUGUGGUCdTsdT | antis |
| 494-513 | 3161 | CACAGUGGUAGCCACUGUA | 3162 | cAcAGuGGuAGccAcuGuAdTsdT | sense |
| 494-513 | 3163 | UACAGUGGCUACCACUGUG | 3164 | uAcAGUGGCuACcACUGUGdTsdT | antis |
| 504-523 | 3165 | GCCACUGUAGGCCAAGGCC | 3166 | GccAcuGuAGGccAAGGccdTsdT | sense |
| 504-523 | 3167 | GGCCUUGGCCUACAGUGGC | 3168 | GGCCUUGGCCuAcAGUGGCdTsdT | antis |
| 593-612 | 3169 | CCAGGCACGGCUGGCAGAG | 3170 | ccAGGcAcGGcuGGcAGAGdTsdT | sense |
| 593-612 | 3171 | CUCUGCCAGCCGUGCCUGG | 3172 | CUCUGCcAGCCGUGCCUGGdTsdT | antis |
| 600-619 | 3173 | CGGCUGGCAGAGACGAGGG | 3174 | cGGcuGGcAGAGAcGAGGGdTsdT | sense |
| 600-619 | 3175 | CCCUCGUCUCUGCCAGCCG | 3176 | CCCUCGUCUCUGCcAGCCGdTsdT | antis |
| 613-632 | 3177 | CGAGGGAACUGGUGGCCAU | 3178 | cGAGGGAAcuGGuGGccAudTsdT | sense |
| 613-632 | 3179 | AUGGCCACCAGUUCCCUCG | 3180 | AUGGCcACcAGUUCCCUCGdTsdT | antis |
| 650-669 | 3181 | CAAAAGGUUCAAGAACCGA | 3182 | cAAAAGGuucAAGAAccGAdTsdT | sense |
| 650-669 | 3183 | UCGGUUCUUGAACCUUUUG | 3184 | UCGGUUCUUGAACCUUUUGdTsdT | antis |
| 841-860 | 3185 | CUAUCAUCUACAUCAAGGU | 3186 | cuAucAucuAcAucAAGGudTsdT | sense |
| 841-860 | 3187 | ACCUUGAUGUAGAUGAUAG | 3188 | ACCUUGAUGuAGAUGAuAGdTsdT | antis |
| 842-861 | 3189 | UAUCAUCUACAUCAAGGUG | 3190 | uAucAucuAcAucAAGGuGdTsdT | sense |
| 842-861 | 3191 | CACCUUGAUGUAGAUGAUA | 3192 | cACCUUGAUGuAGAUGAuAdTsdT | antis |
| 895-914 | 3193 | UCCACUCCCAAGGUGUGUG | 3194 | uccAcucccAAGGuGuGuGdTsdT | sense |
| 895-914 | 3195 | CACACACCUUGGGAGUGGA | 3196 | cAcAcACCUUGGGAGUGGAdTsdT | antis |
| 900-919 | 3197 | UCCCAAGGUGUGUGUCACC | 3198 | ucccAAGGuGuGuGucAccdTsdT | sense |
| 900-919 | 3199 | GGUGACACACACCUUGGGA | 3200 | GGUGAcAcAcACCUUGGGAdTsdT | antis |
| 901-920 | 3201 | CCCAAGGUGUGUGUCACCG | 3202 | cccAAGGuGuGuGucAccGdTsdT | sense |
| 901-920 | 3203 | CGGUGACACACACCUUGGG | 3204 | CGGUGAcAcAcACCUUGGGdTsdT | antis |
| 924-943 | 3205 | AUCAAGCCCCAGAAUUUGC | 3206 | AucAAGccccAGAAuuuGcdTsdT | sense |
| 924-943 | 3207 | GCAAAUUCUGGGGCUUGAU | 3208 | GcAAAUUCUGGGGCUUGAUdTsdT | antis |
| 925-944 | 3209 | UCAAGCCCCAGAAUUUGCU | 3210 | ucAAGccccAGAAuuuGcudTsdT | sense |
| 925-944 | 3211 | AGCAAAUUCUGGGGCUUGA | 3212 | AGcAAAUUCUGGGGCUUGAdTsdT | antis |
| 926-945 | 3213 | CAAGCCCCAGAAUUUGCUU | 3214 | cAAGccccAGAAuuuGcuudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 926-945 | 3215 | AAGCAAAUUCUGGGGCUUG | 3216 | AAGcAAAUUCUGGGGCUUGdTsdT | antis |
| 953-972 | 3217 | UGACACUGCUGUCCUCAAG | 3218 | uGAcAcuGcuGuccucAAGdTsdT | sense |
| 953-972 | 3219 | CUUGAGGACAGCAGUGUCA | 3220 | CUUGAGGAcAGcAGUGUcAdTsdT | antis |
| 1053-1072 | 3221 | CCAGAACUCAUCUUUGGAG | 3222 | ccAGAAcucAucuuuGGAGdTsdT | sense |
| 1053-1072 | 3223 | CUCCAAAGAUGAGUUCUGG | 3224 | CUCcAAAGAUGAGUUCUGGdTsdT | antis |
| 1057-1076 | 3225 | AACUCAUCUUUGGAGCCAC | 3226 | AAcucAucuuuGGAGccAcdTsdT | sense |
| 1057-1076 | 3227 | GUGGCUCCAAAGAUGAGUU | 3228 | GUGGCUCcAAAGAUGAGUUdTsdT | antis |
| 1063-1082 | 3229 | UCUUUGGAGCCACAGAUUA | 3230 | ucuuuGGAGccAcAGAuuAdTsdT | sense |
| 1063-1082 | 3231 | UAAUCUGUGGCUCCAAAGA | 3232 | uAAUCUGUGGCUCcAAAGAdTsdT | antis |
| 1069-1088 | 3233 | GAGCCACAGAUUACACCUC | 3234 | GAGccAcAGAuuAcAccucdTsdT | sense |
| 1069-1088 | 3235 | GAGGUGUAAUCUGUGGCUC | 3236 | GAGGUGuAAUCUGUGGCUCdTsdT | antis |
| 1106-1125 | 3237 | GGCUGGCUGUGUACUUGCU | 3238 | GGcuGGcuGuGuAcuuGcudTsdT | sense |
| 1106-1125 | 3239 | AGCAAGUACACAGCCAGCC | 3240 | AGcAAGuAcAcAGCcAGCCdTsdT | antis |
| 1118-1137 | 3241 | ACUUGCUGAGCUACUUCUC | 3242 | AcuuGcuGAGcuAcuucucdTsdT | sense |
| 1118-1137 | 3243 | GAGAAGUAGCUCAGCAAGU | 3244 | GAGAAGuAGCUcAGcAAGUdTsdT | antis |
| 1135-1154 | 3245 | UCGGCCAGCCCAUCUUCCC | 3246 | ucGGccAGcccAucuucccdTsdT | sense |
| 1135-1154 | 3247 | GGGAAGAUGGGCUGGCCGA | 3248 | GGGAAGAUGGGCUGGCCGAdTsdT | antis |
| 1137-1156 | 3249 | GGCCAGCCCAUCUUCCCUG | 3250 | GGccAGcccAucuucccuGdTsdT | sense |
| 1137-1156 | 3251 | CAGGGAAGAUGGGCUGGCC | 3252 | cAGGGAAGAUGGGCUGGCCdTsdT | antis |
| 1140-1159 | 3253 | CAGCCCAUCUUCCCUGGGG | 3254 | cAGcccAucuucccuGGGGdTsdT | sense |
| 1140-1159 | 3255 | CCCCAGGGAAGAUGGGCUG | 3256 | CCCcAGGGAAGAUGGGCUGdTsdT | antis |
| 1145-1164 | 3257 | CAUCUUCCCUGGGGACAGU | 3258 | cAucuucccuGGGGAcAGudTsdT | sense |
| 1145-1164 | 3259 | ACUGUCCCCAGGGAAGAUG | 3260 | ACUGUCCCcAGGGAAGAUGdTsdT | antis |
| 1150-1169 | 3261 | UCCCUGGGGACAGUGGGGU | 3262 | ucccuGGGGAcAGuGGGGudTsdT | sense |
| 1150-1169 | 3263 | ACCCCACUGUCCCCAGGGA | 3264 | ACCCcACUGUCCCcAGGGAdTsdT | antis |
| 1270-1289 | 3265 | AAGCUCACCCUUGGACAAA | 3266 | AAGcucAcccuuGGAcAAAdTsdT | sense |
| 1270-1289 | 3267 | UUUGUCCAAGGGUGAGCUU | 3268 | UUUGUCcAAGGGUGAGCUUdTsdT | antis |
| 1296-1315 | 3269 | AAAUCUUCAAAGACACCAC | 3270 | AAAucuucAAAGAcAccAcdTsdT | sense |
| 1296-1315 | 3271 | GUGGUGUCUUUGAAGAUUU | 3272 | GUGGUGUCUUUGAAGAUUUdTsdT | antis |
| 1297-1316 | 3273 | AAUCUUCAAAGACACCACC | 3274 | AAucuucAAAGAcAccAccdTsdT | sense |
| 1297-1316 | 3275 | GGUGGUGUCUUUGAAGAUU | 3276 | GGUGGUGUCUUUGAAGAUUdTsdT | antis |
| 1302-1321 | 3277 | UCAAAGACACCACCUGAGG | 3278 | ucAAAGAcAccAccuGAGGdTsdT | sense |
| 1302-1321 | 3279 | CCUCAGGUGGUGUCUUUGA | 3280 | CCUcAGGUGGUGUCUUUGAdTsdT | antis |
| 1309-1328 | 3281 | CACCACCUGAGGCCAUUGC | 3282 | cAccAccuGAGGccAuuGcdTsdT | sense |
| 1309-1328 | 3283 | GCAAUGGCCUCAGGUGGUG | 3284 | GcAAUGGCCUcAGGUGGUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1331-1350 | 3285 | CUGCUCUAGCCUACUGGAG | 3286 | cuGcucuAGccuAcuGGAGdTsdT | sense |
| 1331-1350 | 3287 | CUCCAGUAGGCUAGAGCAG | 3288 | CUCcAGuAGGCuAGAGcAGdTsdT | antis |
| 1422-1441 | 3289 | GGAGCCCAGCUCCCCAACG | 3290 | GGAGcccAGcuccccAAcGdTsdT | sense |
| 1422-1441 | 3291 | CGUUGGGGAGCUGGGCUCC | 3292 | CGUUGGGGAGCUGGGCUCCdTsdT | antis |
| 1441-1460 | 3293 | ACCGCCCGCUUCCCCCCCU | 3294 | AccGcccGcuuccccccudTsdT | sense |
| 1441-1460 | 3295 | AGGGGGGGAAGCGGGCGGU | 3296 | AGGGGGGGAAGCGGGCGGUdTsdT | antis |
| 1475-1494 | 3297 | UGGUGAACUGUCCAUCCAA | 3298 | uGGuGAAcuGuccAuccAAdTsdT | sense |
| 1475-1494 | 3299 | UUGGAUGGACAGUUCACCA | 3300 | UUGGAUGGAcAGUUcACcAdTsdT | antis |
| 1490-1509 | 3301 | CCAACCAUCUCUCAAUGCC | 3302 | ccAAccAucucucAAuGccdTsdT | sense |
| 1490-1509 | 3303 | GGCAUUGAGAGAUGGUUGG | 3304 | GGcAUUGAGAGAUGGUUGGdTsdT | antis |
| 1543-1562 | 3305 | GCCCUGCUUCUCCCCUCAC | 3306 | GcccuGcuucuccccucAcdTsdT | sense |
| 1543-1562 | 3307 | GUGAGGGGAGAAGCAGGGC | 3308 | GUGAGGGGAGAAGcAGGGcdTsdT | antis |
| 1544-1563 | 3309 | CCCUGCUUCUCCCCUCACC | 3310 | cccuGcuucuccccucAccdTsdT | sense |
| 1544-1563 | 3311 | GGUGAGGGGAGAAGCAGGG | 3312 | GGUGAGGGGAGAAGcAGGGdTsdT | antis |
| 1545-1564 | 3313 | CCUGCUUCUCCCCUCACCA | 3314 | ccuGcuucuccccucAccAdTsdT | sense |
| 1545-1564 | 3315 | UGGUGAGGGGAGAAGCAGG | 3316 | UGGuGAGGGGAGAAGcAGGdTsdT | antis |
| 1546-1565 | 3317 | CUGCUUCUCCCCUCACCAC | 3318 | cuGcuucuccccucAccAcdTsdT | sense |
| 1546-1565 | 3319 | GUGGUGAGGGGAGAAGCAG | 3320 | GUGGUGAGGGGAGAAGcAGdTsdT | antis |
| 1550-1569 | 3321 | UUCUCCCCUCACCACUUCC | 3322 | uucuccccucAccAcuuccdTsdT | sense |
| 1550-1569 | 3323 | GGAAGUGGUGAGGGGAGAA | 3324 | GGAAGUGGUGAGGGGAGAAdTsdT | antis |
| 1559-1578 | 3325 | CACCACUUCCUACAACCCA | 3326 | cAccAcuuccuAcAAcccAdTsdT | sense |
| 1559-1578 | 3327 | UGGGUUGUAGGAAGUGGUG | 3328 | UGGGUUGuAGGAAGUGGUGdTsdT | antis |
| 1574-1593 | 3329 | CCCAUCCUCACAAGCUUUA | 3330 | cccAuccucAcAAGcuuuAdTsdT | sense |
| 1574-1593 | 3331 | UAAAGCUUGUGAGGAUGGG | 3332 | uAAAGCUUGUGAGGAUGGGdTsdT | antis |
| 1585-1604 | 3333 | AAGCUUUAACUGAAGCUCA | 3334 | AAGcuuuAAcuGAAGcucAdTsdT | sense |
| 1585-1604 | 3335 | UGAGCUUCAGUUAAAGCUU | 3336 | UGAGCUUcAGUuAAAGCUUdTsdT | antis |
| 1598-1617 | 3337 | AGCUCAGACUGGCCAAGAU | 3338 | AGcucAGAcuGGccAAGAudTsdT | sense |
| 1598-1617 | 3339 | AUCUUGGCCAGUCUGAGCU | 3340 | AUCUUGGCcAGUCUGAGCUdTsdT | antis |
| 1599-1618 | 3341 | GCUCAGACUGGCCAAGAUU | 3342 | GcucAGAcuGGccAAGAuudTsdT | sense |
| 1599-1618 | 3343 | AAUCUUGGCCAGUCUGAGC | 3344 | AAUCUUGGCcAGUCUGAGCdTsdT | antis |
| 1605-1624 | 3345 | ACUGGCCAAGAUUGGCAGC | 3346 | AcuGGccAAGAuuGGcAGCdTsdT | sense |
| 1605-1624 | 3347 | GCUGCCAAUCUUGGCCAGU | 3348 | GCUGCcAAUCUUGGCcAGUdTsdT | antis |
| 1611-1630 | 3349 | CAAGAUUGGCAGCCAUCUG | 3350 | cAAGAuuGGcAGccAucuGdTsdT | sense |
| 1611-1630 | 3351 | CAGAUGGCUGCCAAUCUUG | 3352 | cAGAUGGCUGCcAAUCUUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1612-1631 | 3353 | AAGAUUGGCAGCCAUCUGA | 3354 | AAGAuuGGcAGccAucuGAdTsdT | sense |
| 1612-1631 | 3355 | UCAGAUGGCUGCCAAUCUU | 3356 | UcAGAUGGCUGCcAAUCUUdTsdT | antis |
| 1651-1670 | 3357 | CUAGCUCUUCCUGAGGGCC | 3358 | cuAGcucuuccuGAGGGccdTsdT | sense |
| 1651-1670 | 3359 | GGCCCUCAGGAAGAGCUAG | 3360 | GGCCCUcAGGAAGAGCuAGdTsdT | antis |
| 1655-1674 | 3361 | CUCUUCCUGAGGGCCCCAC | 3362 | cucuuccuGAGGGccccAcdTsdT | sense |
| 1655-1674 | 3363 | GUGGGGCCCUCAGGAAGAG | 3364 | GUGGGGCCCUcAGGAAGAGdTsdT | antis |
| 1656-1675 | 3365 | UCUUCCUGAGGGCCCCACC | 3366 | ucuuccuGAGGGccccAccdTsdT | sense |
| 1656-1675 | 3367 | GGUGGGGCCCUCAGGAAGA | 3368 | GGUGGGGCCCUcAGGAAGAdTsdT | antis |
| 1803-1822 | 3369 | UAGGCCUCCCUCAGCAGCC | 3370 | uAGGccucccucAGcAGccdTsdT | sense |
| 1803-1822 | 3371 | GGCUGCUGAGGGAGGCCUA | 3372 | GGCUGCUGAGGGAGGCCuAdTsdT | antis |
| 1804-1823 | 3373 | AGGCCUCCCUCAGCAGCCU | 3374 | AGGccucccucAGcAGccudTsdT | sense |
| 1804-1823 | 3375 | AGGCUGCUGAGGGAGGCCU | 3376 | AGGCUGCUGAGGGAGGCCUdTsdT | antis |
| 1805-1824 | 3377 | GGCCUCCCUCAGCAGCCUA | 3378 | GGccucccucAGcAGccuAdTsdT | sense |
| 1805-1824 | 3379 | UAGGCUGCUGAGGGAGGCC | 3380 | uAGGCUGCUGAGGGAGGCCdTsdT | antis |
| 1806-1825 | 3381 | GCCUCCCUCAGCAGCCUAA | 3382 | GccucccucAGcAGccuAAdTsdT | sense |
| 1806-1825 | 3383 | UUAGGCUGCUGAGGGAGGC | 3384 | UuAGGCUGCUGAGGGAGGCdTsdT | antis |
| 1810-1829 | 3385 | CCCUCAGCAGCCUAACCUC | 3386 | cccucAGcAGccuAAccucdTsdT | sense |
| 1810-1829 | 3387 | GAGGUUAGGCUGCUGAGGG | 3388 | GAGGUuAGGCUGCUGAGGGdTsdT | antis |
| 1846-1865 | 3389 | AGAGGAUUUUAACUGUUUG | 3390 | AGAGGAuuuuAAcuGuuuGdTsdT | sense |
| 1846-1865 | 3391 | CAAACAGUUAAAAUCCUCU | 3392 | cAAAcAGUuAAAAUCCUCUdTsdT | antis |
| 1871-1890 | 3393 | AGGGGAGAAAAGGAAGGAC | 3394 | AGGGGAGAAAAGGAAGGAcdTsdT | sense |
| 1871-1890 | 3395 | GUCCUUCCUUUUCUCCCCU | 3396 | GUCCUUCCUUUUCUCCCCUdTsdT | antis |
| 1873-1892 | 3397 | GGGAGAAAAGGAAGGACGG | 3398 | GGGAGAAAAGGAAGGAcGGdTsdT | sense |
| 1873-1892 | 3399 | CCGUCCUUCCUUUUCUCCC | 3400 | CCGUCCUUCCUUUUCUCCCdTsdT | antis |
| 1877-1896 | 3401 | GAAAAGGAAGGACGGGGUU | 3402 | GAAAAGGAAGGAcGGGGuudTsdT | sense |
| 1877-1896 | 3403 | AACCCCGUCCUUCCUUUUC | 3404 | AACCCCGUCCUUCCUUUUCdTsdT | antis |
| 1933-1952 | 3405 | CCCUCCCCCAGGCUACCAC | 3406 | cccuccccCAGGcuAccAcdTsdT | sense |
| 1933-1952 | 3407 | GUGGUAGCCUGGGGGAGGG | 3408 | GUGGuAGCCUGGGGGAGGGdTsdT | antis |
| 1934-1953 | 3409 | CCUCCCCCAGGCUACCACU | 3410 | ccuccccCAGGcuAccAcudTsdT | sense |
| 1934-1953 | 3411 | AGUGGUAGCCUGGGGGAGG | 3412 | AGUGGuAGCCUGGGGGAGGdTsdT | antis |
| 1940-1959 | 3413 | CCAGGCUACCACUCCUUCC | 3414 | ccAGGcuAccAcuccuuccdTsdT | sense |
| 1940-1959 | 3415 | GGAAGGAGUGGUAGCCUGG | 3416 | GGAAGGAGUGGuAGCCUGGdTsdT | antis |
| 1941-1960 | 3417 | CAGGCUACCACUCCUUCCC | 3418 | cAGGcuAccAcuccuucccdTsdT | sense |
| 1941-1960 | 3419 | GGGAAGGAGUGGUAGCCUG | 3420 | GGGAAGGAGUGGuAGCCUGdTsdT | antis |
| 1945-1964 | 3421 | CUACCACUCCUUCCCUCCC | 3422 | cuAccAcuccuucccucccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1945-1964 | 3423 | GGGAGGGAAGGAGUGGUAG | 3424 | GGGAGGGAAGGAGUGGuAGdTsdT | antis |
| 1946-1965 | 3425 | UACCACUCCUUCCCUCCCC | 3426 | uAccAcuccuucccuccccdTsdT | sense |
| 1946-1965 | 3427 | GGGGAGGGAAGGAGUGGUA | 3428 | GGGGAGGGAAGGAGUGGuAdTsdT | antis |
| 1953-1972 | 3429 | CCUUCCCUCCCCCCCUCUC | 3430 | ccuucccuccccccucucdTsdT | sense |
| 1953-1972 | 3431 | GAGAGGGGGGGAGGGAAGG | 3432 | GAGAGGGGGGGAGGGAAGGdTsdT | antis |
| 2023-2042 | 3433 | CCUGGCCCCUGGGUGUAA | 3434 | ccuGGccccuGGGuGuAAdTsdT | sense |
| 2023-2042 | 3435 | UUACACCCAGGGGGCCAGG | 3436 | UuAcACCcAGGGGGCcAGGdTsdT | antis |
| 2024-2043 | 3437 | CUGGCCCCUGGGUGUAAA | 3438 | cuGGccccuGGGuGuAAAdTsdT | sense |
| 2024-2043 | 3439 | UUUACACCCAGGGGGCCAG | 3440 | UUuAcACCcAGGGGGCcAGdTsdT | antis |
| 2040-2059 | 3441 | AAAUAGAUUGUUAUAAUUU | 3442 | AAAuAGAuuGuuAuAAuuudTsdT | sense |
| 2040-2059 | 3443 | AAAUUAUAACAAUCUAUUU | 3444 | AAAUuAuAAcAAUCuAUUUdTsdT | antis |
| 2043-2062 | 3445 | UAGAUUGUUAUAAUUUUUU | 3446 | uAGAuuGuuAuAAuuuuuudTsdT | sense |
| 2043-2062 | 3447 | AAAAAAUUAUAACAAUCUA | 3448 | AAAAAAUuAuAAcAAUCuAdTsdT | antis |
| 2044-2063 | 3449 | AGAUUGUUAUAAUUUUUUC | 3450 | AGAuuGuuAuAAuuuuuucdTsdT | sense |
| 2044-2063 | 3451 | GAAAAAAUUAUAACAAUCU | 3452 | GAAAAAAUuAuAAcAAUCUdTsdT | antis |
| 2045-2064 | 3453 | GAUUGUUAUAAUUUUUUCU | 3454 | GAuuGuuAuAAuuuuuucudTsdT | sense |
| 2045-2064 | 3455 | AGAAAAAAUUAUAACAAUC | 3456 | AGAAAAAAUuAuAAcAAUCdTsdT | antis |
| 2046-2065 | 3457 | AUUGUUAUAAUUUUUUCUU | 3458 | AuuGuuAuAAuuuuuucuudTsdT | sense |
| 2046-2065 | 3459 | AAGAAAAAAUUAUAACAAU | 3460 | AAGAAAAAAUuAuAAcAAUdTsdT | antis |
| 2049-2068 | 3461 | GUUAUAAUUUUUUCUUAAA | 3462 | GuuAuAAuuuuuucuuAAAdTsdT | sense |
| 2049-2068 | 3463 | UUUAAGAAAAAAUUAUAAC | 3464 | UUuAAGAAAAAAUuAuAACdTsdT | antis |
| 2117-2136 | 3465 | UCUUGUCCUCUGCUCCCAA | 3466 | ucuuGuccucuGcucccAAdTsdT | sense |
| 2117-2136 | 3467 | UUGGGAGCAGAGGACAAGA | 3468 | UUGGGAGcAGAGGAcAAGAdTsdT | antis |
| 2118-2137 | 3469 | CUUGUCCUCUGCUCCCAAG | 3470 | cuuGuccucuGcucccAAGdTsdT | sense |
| 2118-2137 | 3471 | CUUGGGAGCAGAGGACAAG | 3472 | CUUGGGAGcAGAGGAcAAGdTsdT | antis |
| 2129-2148 | 3473 | CUCCCAAGGCUUCCUCCCU | 3474 | cucccAAGGcuuccucccudTsdT | sense |
| 2129-2148 | 3475 | AGGGAGGAAGCCUUGGGAG | 3476 | AGGGAGGAAGCCUUGGGAGdTsdT | antis |
| 2130-2149 | 3477 | UCCCAAGGCUUCCUCCCUC | 3478 | ucccAAGGcuuccucccucdTsdT | sense |
| 2130-2149 | 3479 | GAGGGAGGAAGCCUUGGGA | 3480 | GAGGGAGGAAGCCUUGGGAdTsdT | antis |
| 2133-2152 | 3481 | CAAGGCUUCCUCCCUCUCC | 3482 | cAAGGcuuccucccucuccdTsdT | sense |
| 2133-2152 | 3483 | GGAGAGGGAGGAAGCCUUG | 3484 | GGAGAGGGAGGAAGCCUUGdTsdT | antis |
| 2134-2153 | 3485 | AAGGCUUCCUCCCUCUCCC | 3486 | AAGGcuuccucccucucccdTsdT | sense |
| 2134-2153 | 3487 | GGGAGAGGGAGGAAGCCUU | 3488 | GGGAGAGGGAGGAAGCCUUdTsdT | antis |
| 2146-2165 | 3489 | CUCUCCCCAUCCUGGAAGG | 3490 | cucuccccAuccuGGAAGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2146-2165 | 3491 | CCUUCCAGGAUGGGGAGAG | 3492 | CCUUCcAGGAUGGGGAGAGdTsdT | antis |
| 2150-2169 | 3493 | CCCCAUCCUGGAAGGAGGG | 3494 | ccccAuccuGGAAGGAGGGdTsdT | sense |
| 2150-2169 | 3495 | CCCUCCUUCCAGGAUGGGG | 3496 | CCCUCCUUCcAGGAUGGGGdTsdT | antis |
| 2152-2171 | 3497 | CCAUCCUGGAAGGAGGGGA | 3498 | ccAuccuGGAAGGAGGGGAdTsdT | sense |
| 2152-2171 | 3499 | UCCCCUCCUUCCAGGAUGG | 3500 | UCCCCUCCUUCcAGGAUGGdTsdT | antis |
| 2156-2175 | 3501 | CCUGGAAGGAGGGGAGUAG | 3502 | ccuGGAAGGAGGGGAGuAGdTsdT | sense |
| 2156-2175 | 3503 | CUACUCCCCUCCUUCCAGG | 3504 | CuACUCCCCUCCUUCcAGGdTsdT | antis |
| 2161-2180 | 3505 | AAGGAGGGGAGUAGAGAGA | 3506 | AAGGAGGGGAGuAGAGAGAdTsdT | sense |
| 2161-2180 | 3507 | UCUCUCUACUCCCCUCCUU | 3508 | UCUCUCuACUCCCCUCCUUdTsdT | antis |
| 2208-2227 | 3509 | GGUUUGCCUGUGUACAGAC | 3510 | GGuuuGccuGuGuACAGAcdTsdT | sense |
| 2208-2227 | 3511 | GUCUGUACACAGGCAAACC | 3512 | GUCUGuAcAcAGGcAAACCdTsdT | antis |
| 2219-2238 | 3513 | GUACAGACCUCUGUUCAAU | 3514 | GuAcAGAccucuGuucAAudTsdT | sense |
| 2219-2238 | 3515 | AUUGAACAGAGGUCUGUAC | 3516 | AUUGAAcAGAGGUCUGuACdTsdT | antis |
| 2233-2252 | 3517 | UCAAUAAAUUAUUGGCAUG | 3518 | ucAAuAAAuuAuuGGcAuGdTsdT | sense |
| 2233-2252 | 3519 | CAUGCCAAUAAUUUAUUGA | 3520 | cAUGCcAAuAAUUuAUUGAdTsdT | antis |
| 2-21 | 3521 | UGGUGACAACGAAGCCGAC | 3522 | uGGuGAcAAcGAAGccGAcdTsdT | sense |
| 2-21 | 3523 | GUCGGCUUCGUUGUCACCA | 3524 | GUCGGCUUCGUUGUcACcAdTsdT | antis |
| 138-157 | 3525 | GCGGGGGCAGCCCAGGCAG | 3526 | GcGGGGGcAGcccAGGcAGdTsdT | sense |
| 138-157 | 3527 | CUGCCUGGGCUGCCCCCGC | 3528 | CUGCCUGGGCUGCCCCCGCdTsdT | antis |
| 381-400 | 3529 | AGCUCCGGGGGUGGCCCCA | 3530 | AGcuccGGGGGuGGccccAdTsdT | sense |
| 381-400 | 3531 | UGGGGCCACCCCCGGAGCU | 3532 | UGGGGCcACCCCCGGAGCUdTsdT | antis |
| 592-611 | 3533 | ACCAGGCACGGCUGGCAGA | 3534 | AccAGGcAcGGcuGGcAGAdTsdT | sense |
| 592-611 | 3535 | UCUGCCAGCCGUGCCUGGU | 3536 | UCUGCcAGCCGUGCCUGGUdTsdT | antis |
| 615-634 | 3537 | AGGGAACUGGUGGCCAUCA | 3538 | AGGGAAcuGGuGGccAucAdTsdT | sense |
| 615-634 | 3539 | UGAUGGCCACCAGUUCCCU | 3540 | UGAUGGCcACcAGUUCCCUdTsdT | antis |
| 1026-1045 | 3541 | UACAUCUGCUCUCGGUACU | 3542 | uAcAucuGcucucGGuAcudTsdT | sense |
| 1026-1045 | 3543 | AGUACCGAGAGCAGAUGUA | 3544 | AGuACCGAGAGcAGAUGuAdTsdT | antis |
| 1027-1046 | 3545 | ACAUCUGCUCUCGGUACUA | 3546 | AcAucuGcucucGGuAcuAdTsdT | sense |
| 1027-1046 | 3547 | UAGUACCGAGAGCAGAUGU | 3548 | uAGuACCGAGAGcAGAUGUdTsdT | antis |
| 1105-1124 | 3549 | CGGCUGGCUGUGUACUUGC | 3550 | cGGcuGGcuGuGuAcuuGcdTsdT | sense |
| 1105-1124 | 3551 | GCAAGUACACAGCCAGCCG | 3552 | GcAAGuAcAcAGCcAGCCGdTsdT | antis |
| 1362-1381 | 3553 | UCAAGGCUCUCCCCACUCG | 3554 | ucAAGGcucuccccAcucGdTsdT | sense |
| 1362-1381 | 3555 | CGAGUGGGGAGAGCCUUGA | 3556 | CGAGUGGGGAGAGCCUUGAdTsdT | antis |
| 1440-1459 | 3557 | GACCGCCCGCUUCCCCCCC | 3558 | GAccGcccGcuuccccccCdTsdT | sense |
| 1440-1459 | 3559 | GGGGGGGAAGCGGGCGGUC | 3560 | GGGGGGGAAGCGGGCGGUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2017-2036 | 3561 | CCCUUCCCUGGCCCCCUGG | 3562 | cccuucccuGGcccccuGGdTsdT | sense |
| 2017-2036 | 3563 | CCAGGGGGCCAGGGAAGGG | 3564 | CcAGGGGGCcAGGGAAGGGdTsdT | antis |
| 2018-2037 | 3565 | CCUUCCCUGGCCCCCUGGG | 3566 | ccuucccuGGcccccuGGGdTsdT | sense |
| 2018-2037 | 3567 | CCCAGGGGGCCAGGGAAGG | 3568 | CCcAGGGGGCcAGGGAAGGdTsdT | antis |
| 2019-2038 | 3569 | CUUCCCUGGCCCCCUGGGU | 3570 | cuucccuGGcccccuGGGudTsdT | sense |
| 2019-2038 | 3571 | ACCCAGGGGGCCAGGGAAG | 3572 | ACCcAGGGGGCcAGGGAAGdTsdT | antis |
| 2148-2167 | 3573 | CUCCCCAUCCUGGAAGGAG | 3574 | cuccccAuccuGGAAGGAGdTsdT | sense |
| 2148-2167 | 3575 | CUCCUUCCAGGAUGGGGAG | 3576 | CUCCUUCcAGGAUGGGGAGdTsdT | antis |
| 2149-2168 | 3577 | UCCCCAUCCUGGAAGGAGG | 3578 | uccccAuccuGGAAGGAGGdTsdT | sense |
| 2149-2168 | 3579 | CCUCCUUCCAGGAUGGGGA | 3580 | CCUCCUUCcAGGAUGGGGAdTsdT | antis |
| 1335-1354 | 3581 | UCUAGCCUACUGGAGUACA | 3582 | ucuAGccuAcuGGAGuAcAdTsdT | sense |
| 1335-1354 | 3583 | UGUACUCCAGUAGGCUAGA | 3584 | UGuACUCcAGuAGGCuAGAdTsdT | antis |
| 342-361 | 3585 | GCGUCAGUCGGGCUAUGG | 3586 | GcGucAGucGGGcuAuGGdTsdT | sense |
| 342-361 | 3587 | CCAUAGCCCGACUGACGC | 3588 | CcAuAGCCCGACUGACGCdTsdT | antis |
| 675-694 | 3589 | CAGAUUAUGCGUAAGCUGG | 3590 | cAGAuuAuGcGuAAGcuGGdTsdT | sense |
| 675-694 | 3591 | CCAGCUUACGCAUAAUCUG | 3592 | CcAGCUuACGcAuAAUCUGdTsdT | antis |
| 1080-1099 | 3593 | UACACCUCGUCCAUCGAUG | 3594 | uAcAccucGuccAucGAuGdTsdT | sense |
| 1080-1099 | 3595 | CAUCGAUGGACGAGGUGUA | 3596 | cAUCGAUGGACGAGGUGuAdTsdT | antis |
| 333-352 | 3597 | GGCGGGAAAGCGUCAGUCG | 3598 | GGcGGGAAAGcGucAGucGdTsdT | sense |
| 333-352 | 3599 | CGACUGACGCUUUCCCGCC | 3600 | CGACUGACGCUUUCCCGCCdTsdT | antis |
| 475-494 | 3601 | GUGACAGCGGGAAGGUGAC | 3602 | GuGAcAGcGGGAAGGuGAcdTsdT | sense |
| 475-494 | 3603 | GUCACCUUCCCGCUGUCAC | 3604 | GUcACCUUCCCGCUGUcACdTsdT | antis |
| 533-552 | 3605 | CCAAGAAGUGGCUUACACU | 3606 | ccAAGAAGuGGcuuAcAcudTsdT | sense |
| 533-552 | 3607 | AGUGUAAGCCACUUCUUGG | 3608 | AGUGuAAGCcACUUCUUGGdTsdT | antis |
| 746-765 | 3609 | GAAGGACGAGCUGUAUUUG | 3610 | GAAGGAcGAGcuGuAuuuGdTsdT | sense |
| 746-765 | 3611 | CAAAUACAGCUCGUCCUUC | 3612 | cAAAuAcAGCUCGUCCUUCdTsdT | antis |
| 747-766 | 3613 | AAGGACGAGCUGUAUUUGA | 3614 | AAGGAcGAGcuGuAuuuGAdTsdT | sense |
| 747-766 | 3615 | UCAAAUACAGCUCGUCCUU | 3616 | UcAAAuAcAGCUCGUCCUUdTsdT | antis |
| 830-849 | 3617 | GCUGAUCACCCCUAUCAUC | 3618 | GcuGAucAccccuAucAucdTsdT | sense |
| 830-849 | 3619 | GAUGAUAGGGGUGAUCAGC | 3620 | GAUGAuAGGGGUGAUcAGCdTsdT | antis |
| 1334-1353 | 3621 | CUCUAGCCUACUGGAGUAC | 3622 | cucuAGccuAcuGGAGuAcdTsdT | sense |
| 1334-1353 | 3623 | GUACUCCAGUAGGCUAGAG | 3624 | GuACUCcAGuAGGCuAGAGdTsdT | antis |
| 497-516 | 3625 | AGUGGUAGCCACUGUAGGC | 3626 | AGuGGuAGccAcuGuAGGcdTsdT | sense |
| 497-516 | 3627 | GCCUACAGUGGCUACCACU | 3628 | GCCuAcAGUGGCuACcACUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1641-1660 | 3629 | GCUACCCUCGCUAGCUCUU | 3630 | GcuAcccucGcuAGcucuudTsdT | sense |
| 1641-1660 | 3631 | AAGAGCUAGCGAGGGUAGC | 3632 | AAGAGCuAGCGAGGGuAGCdTsdT | antis |
| 1642-1661 | 3633 | CUACCCUCGCUAGCUCUUC | 3634 | cuAcccucGcuAGcucuucdTsdT | sense |
| 1642-1661 | 3635 | GAAGAGCUAGCGAGGGUAG | 3636 | GAAGAGCuAGCGAGGGuAGdTsdT | antis |
| 676-695 | 3637 | AGAUUAUGCGUAAGCUGGA | 3638 | AGAuuAuGcGuAAGcuGGAdTsdT | sense |
| 676-695 | 3639 | UCCAGCUUACGCAUAAUCU | 3640 | UCcAGCUuACGcAuAAUCUdTsdT | antis |
| 1128-1147 | 3641 | CUACUUCUCGGCCAGCCCA | 3642 | cuAcuucucGGccAGcccAdTsdT | sense |
| 1128-1147 | 3643 | UGGGCUGGCCGAGAAGUAG | 3644 | UGGGCUGGCCGAGAAGuAGdTsdT | antis |
| 40-59 | 3645 | CCGGCGUGCCCCGCGGCGG | 3646 | ccGGcGuGccccGcGGcGGdTsdT | sense |
| 40-59 | 3647 | CCGCCGCGGGGCACGCCGG | 3648 | CCGCCGCGGGGcACGCCGGdTsdT | antis |
| 199-218 | 3649 | GCGGCGGGCCUUCGGGAGG | 3650 | GcGGcGGGccuucGGGAGGdTsdT | sense |
| 199-218 | 3651 | CCUCCCGAAGGCCCGCCGC | 3652 | CCUCCCGAAGGCCCGCCGCdTsdT | antis |
| 222-241 | 3653 | CCUGGGGGCUCGGGCCGGG | 3654 | ccuGGGGGcucGGGccGGGdTsdT | sense |
| 222-241 | 3655 | CCCGGCCCGAGCCCCCAGG | 3656 | CCCGGCCCGAGCCCCcAGGdTsdT | antis |
| 343-362 | 3657 | CGUCAGUCGGGGCUAUGGG | 3658 | cGucAGucGGGGcuAuGGGdTsdT | sense |
| 343-362 | 3659 | CCCAUAGCCCCGACUGACG | 3660 | CCcAuAGCCCCGACUGACGdTsdT | antis |
| 437-456 | 3661 | GGGCACUAGCUUCCCGCCG | 3662 | GGGcAcuAGcuucccGccGdTsdT | sense |
| 437-456 | 3663 | CGGCGGGAAGCUAGUGCCC | 3664 | CGGCGGGAAGCuAGUGCCCdTsdT | antis |
| 538-557 | 3665 | AAGUGGCUUACACUGACAU | 3666 | AAGuGGcuuAcAcuGAcAudTsdT | sense |
| 538-557 | 3667 | AUGUCAGUGUAAGCCACUU | 3668 | AUGUcAGUGuAAGCcACUUdTsdT | antis |
| 663-682 | 3669 | AACCGAGAACUGCAGAUUA | 3670 | AAccGAGAAcuGcAGAuuAdTsdT | sense |
| 663-682 | 3671 | UAAUCUGCAGUUCUCGGUU | 3672 | uAAUCUGcAGUUCUCGGUUdTsdT | antis |
| 887-906 | 3673 | GGCCUACAUCCACUCCCAA | 3674 | GGccuAcAuccAcucccAAdTsdT | sense |
| 887-906 | 3675 | UUGGGAGUGGAUGUAGGCC | 3676 | UUGGGAGUGGAUGuAGGCCdTsdT | antis |
| 997-1016 | 3677 | AGCUGGUUCGGGGGAGCC | 3678 | AGcuGGuucGGGGGAGccdTsdT | sense |
| 997-1016 | 3679 | GGCUCCCCCCGAACCAGCU | 3680 | GGCUCCCCCCGAACcAGCUdTsdT | antis |
| 1079-1098 | 3681 | UUACACCUCGUCCAUCGAU | 3682 | uuAcAccucGuccAucGAudTsdT | sense |
| 1079-1098 | 3683 | AUCGAUGGACGAGGUGUAA | 3684 | AUCGAUGGACGAGGUGuAAdTsdT | antis |
| 1323-1342 | 3685 | AUUGCACUCUGCUCUAGCC | 3686 | AuuGcAcucuGcucuAGccdTsdT | sense |
| 1323-1342 | 3687 | GGCUAGAGCAGAGUGCAAU | 3688 | GGCuAGAGcAGAGUGcAAUdTsdT | antis |
| 1370-1389 | 3689 | CUCCCCACUCGAGGCUUGU | 3690 | cuccccAcucGAGGcuuGudTsdT | sense |
| 1370-1389 | 3691 | ACAAGCCUCGAGUGGGGAG | 3692 | AcAAGCCUCGAGUGGGGAGdTsdT | antis |
| 1494-1513 | 3693 | CCAUCUCUCAAUGCCAUUC | 3694 | ccAucucucAAuGccAuucdTsdT | sense |
| 1494-1513 | 3695 | GAAUGGCAUUGAGAGAUGG | 3696 | GAAUGGcAUUGAGAGAUGGdTsdT | antis |
| 57-76 | 3697 | GGGCGCUGGGCCGGAGCCG | 3698 | GGGcGcuGGGccGGAGccGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 57-76 | 3699 | CGGCUCCGGCCCAGCGCCC | 3700 | CGGCUCCGGCCcAGCGCCCdTsdT | antis |
| 137-156 | 3701 | GGCGGGGGCAGCCCAGGCA | 3702 | GGcGGGGGcAGcccAGGcAdTsdT | sense |
| 137-156 | 3703 | UGCCUGGGCUGCCCCCGCC | 3704 | UGCCUGGGCUGCCCCCGCCdTsdT | antis |
| 141-160 | 3705 | GGGGCAGCCCAGGCAGCCC | 3706 | GGGGcAGcccAGGcAGcccdTsdT | sense |
| 141-160 | 3707 | GGGCUGCCUGGGCUGCCCC | 3708 | GGGCUGCCUGGGCUGCCCCdTsdT | antis |
| 198-217 | 3709 | GGCGGCGGGCCUUCGGGAG | 3710 | GGcGGcGGGccuucGGGAGdTsdT | sense |
| 198-217 | 3711 | CUCCCGAAGGCCCGCCGCC | 3712 | CUCCCGAAGGCCCGCCGCCdTsdT | antis |
| 319-338 | 3713 | CAGGAGGCACUGGCGGCGG | 3714 | cAGGAGGcAcuGGcGGcGGdTsdT | sense |
| 319-338 | 3715 | CCGCCGCCAGUGCCUCCUG | 3716 | CCGCCGCcAGUGCCUCCUGdTsdT | antis |
| 417-436 | 3717 | GGCAGCGGUGGCCCCGGCG | 3718 | GGcAGcGGuGGCcccGGcGdTsdT | sense |
| 417-436 | 3719 | CGCCGGGGCCACCGCUGCC | 3720 | CGCCGGGGCcACCGCUGCCdTsdT | antis |
| 490-509 | 3721 | UGACCACAGUGGUAGCCAC | 3722 | uGAccAcAGuGGuAGccAcdTsdT | sense |
| 490-509 | 3723 | GUGGCUACCACUGUGGUCA | 3724 | GUGGCuAccACUGUGGUcAdTsdT | antis |
| 503-522 | 3725 | AGCCACUGUAGGCCAAGGC | 3726 | AGccAcuGuAGGccAAGGcdTsdT | sense |
| 503-522 | 3727 | GCCUUGGCCUACAGUGGCU | 3728 | GCCUUGGCCuAcAGUGGCUdTsdT | antis |
| 539-558 | 3729 | AGUGGCUUACACUGACAUC | 3730 | AGuGGcuuAcAcuGAcAucdTsdT | sense |
| 539-558 | 3731 | GAUGUCAGUGUAAGCCACU | 3732 | GAUGUcAGUGuAAGCcACUdTsdT | antis |
| 602-621 | 3733 | GCUGGCAGAGACGAGGGAA | 3734 | GcuGGcAGAGAcGAGGGAAdTsdT | sense |
| 602-621 | 3735 | UUCCCUCGUCUCUGCCAGC | 3736 | UUCCCUCGUCUCUGCcAGCdTsdT | antis |
| 793-812 | 3737 | CGGUGUACCGAGUGGCCCG | 3738 | cGGuGuAccGAGuGGcccGdTsdT | sense |
| 793-812 | 3739 | CGGGCCACUCGGUACACCG | 3740 | CGGGCcACUCGGuAcACCGdTsdT | antis |
| 825-844 | 3741 | GCCAAGCUGAUCACCCCUA | 3742 | GccAAGcuGAucAccccuAdTsdT | sense |
| 825-844 | 3743 | UAGGGGUGAUCAGCUUGGC | 3744 | uAGGGGUGAUcAGCUUGGCdTsdT | antis |
| 829-848 | 3745 | AGCUGAUCACCCCUAUCAU | 3746 | AGcuGAucAccccuAucAudTsdT | sense |
| 829-848 | 3747 | AUGAUAGGGGUGAUCAGCU | 3748 | AUGAuAGGGGUGAUcAGCUdTsdT | antis |
| 843-862 | 3749 | AUCAUCUACAUCAAGGUGU | 3750 | AucAucuAcAucAAGGuGudTsdT | sense |
| 843-862 | 3751 | ACACCUUGAUGUAGAUGAU | 3752 | AcACCUUGAUGuAGAUGAUdTsdT | antis |
| 844-863 | 3753 | UCAUCUACAUCAAGGUGUA | 3754 | ucAucuAcAucAAGGuGuAdTsdT | sense |
| 844-863 | 3755 | UACACCUUGAUGUAGAUGA | 3756 | uAcACCUUGAUGuAGAUGAdTsdT | antis |
| 888-907 | 3757 | GCCUACAUCCACUCCCAAG | 3758 | GccuAcAuccAcucccAAGdTsdT | sense |
| 888-907 | 3759 | CUUGGGAGUGGAUGUAGGC | 3760 | CUUGGGAGUGGAUGuAGGCdTsdT | antis |
| 902-921 | 3761 | CCAAGGUGUGUGUCACCGU | 3762 | ccAAGGuGuGuGucAccGudTsdT | sense |
| 902-921 | 3763 | ACGGUGACACACACCUUGG | 3764 | ACGGUGAcAcAcACCUUGGdTsdT | antis |
| 1067-1086 | 3765 | UGGAGCCACAGAUUACACC | 3766 | uGGAGccAcAGAuuAcAccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1067-1086 | 3767 | GGUGUAAUCUGUGGCUCCA | 3768 | GGUGuAAUCUGUGGCUCcAdTsdT | antis |
| 1095-1114 | 3769 | GAUGUGUGGUCGGCUGGCU | 3770 | GAuGuGuGGucGGcuGGcudTsdT | sense |
| 1095-1114 | 3771 | AGCCAGCCGACCACACAUC | 3772 | AGCcAGCCGACcAcAcAUCdTsdT | antis |
| 1154-1173 | 3773 | UGGGGACAGUGGGGUGGAC | 3774 | uGGGGAcAGuGGGGuGGAcdTsdT | sense |
| 1154-1173 | 3775 | GUCCACCCCACUGUCCCCA | 3776 | GUCcACCCcACUGUCCCcAdTsdT | antis |
| 1271-1290 | 3777 | AGCUCACCCUUGGACAAAG | 3778 | AGcucAcccuuGGAcAAAGdTsdT | sense |
| 1271-1290 | 3779 | CUUUGUCCAAGGGUGAGCU | 3780 | CUUUGUCcAAGGGUGAGCUdTsdT | antis |
| 1272-1291 | 3781 | GCUCACCCUUGGACAAAGG | 3782 | GcucAcccuuGGAcAAAGGdTsdT | sense |
| 1272-1291 | 3783 | CCUUUGUCCAAGGGUGAGC | 3784 | CCUUUGUCcAAGGGUGAGCdTsdT | antis |
| 1289-1308 | 3785 | GGUGUUCAAAUCUUCAAAG | 3786 | GGuGuucAAAucuucAAAGdTsdT | sense |
| 1289-1308 | 3787 | CUUUGAAGAUUUGAACACC | 3788 | CUUUGAAGAUUUGAcACCdTsdT | antis |
| 1324-1343 | 3789 | UUGCACUCUGCUCUAGCCU | 3790 | uuGcAcucuGcucuAGccudTsdT | sense |
| 1324-1343 | 3791 | AGGCUAGAGCAGAGUGCAA | 3792 | AGGCuAGAGcAGAGUGcAAdTsdT | antis |
| 1351-1370 | 3793 | ACACGCCAUCCUCAAGGCU | 3794 | AcAcGccAuccucAAGGcudTsdT | sense |
| 1351-1370 | 3795 | AGCCUUGAGGAUGGCGUGU | 3796 | AGCCUUGAGGAUGGCGUGUdTsdT | antis |
| 1371-1390 | 3797 | UCCCCACUCGAGGCUUGUG | 3798 | uccccAcucGAGGcuuGuGdTsdT | sense |
| 1371-1390 | 3799 | CACAAGCCUCGAGUGGGGA | 3800 | cAcAAGCCUCGAGUGGGGAdTsdT | antis |
| 1392-1411 | 3801 | CACAGCUUCUUCGAUGAAC | 3802 | cAcAGcuucuucGAuGAAcdTsdT | sense |
| 1392-1411 | 3803 | GUUCAUCGAAGAAGCUGUG | 3804 | GUUcAUCGAAGAAGCUGUGdTsdT | antis |
| 1395-1414 | 3805 | AGCUUCUUCGAUGAACUGC | 3806 | AGcuucuucGAuGAAcuGcdTsdT | sense |
| 1395-1414 | 3807 | GCAGUUCAUCGAAGAAGCU | 3808 | GcAGUUcAUCGAAGAAGCUdTsdT | antis |
| 1439-1458 | 3809 | CGACCGCCCGCUUCCCCCC | 3810 | cGAccGcccGcuuccccccdTsdT | sense |
| 1439-1458 | 3811 | GGGGGGAAGCGGGCGGUCG | 3812 | GGGGGGAAGCGGGCGGUCGdTsdT | antis |
| 1442-1461 | 3813 | CCGCCCGCUUCCCCCCCUG | 3814 | ccGcccGcuuccccccuGdTsdT | sense |
| 1442-1461 | 3815 | CAGGGGGGAAGCGGGCGG | 3816 | cAGGGGGGAAGCGGGCGGdTsdT | antis |
| 1467-1486 | 3817 | UUCAGUCCUGGUGAACUGU | 3818 | uucAGuccuGGuGAAcuGudTsdT | sense |
| 1467-1486 | 3819 | ACAGUUCACCAGGACUGAA | 3820 | AcAGUUcACcAGGACUGAAdTsdT | antis |
| 1468-1487 | 3821 | UCAGUCCUGGUGAACUGUC | 3822 | ucAGuccuGGuGAAcuGucdTsdT | sense |
| 1468-1487 | 3823 | GACAGUUCACCAGGACUGA | 3824 | GAcAGUUcACcAGGACUGAdTsdT | antis |
| 1482-1501 | 3825 | CUGUCCAUCCAACCAUCUC | 3826 | cuGuccAuccAAccAucucdTsdT | sense |
| 1482-1501 | 3827 | GAGAUGGUUGGAUGGACAG | 3828 | GAGAUGGUUGGAUGGAcAGdTsdT | antis |
| 1483-1502 | 3829 | UGUCCAUCCAACCAUCUCU | 3830 | uGuccAuccAAccAucucudTsdT | sense |
| 1483-1502 | 3831 | AGAGAUGGUUGGAUGGACA | 3832 | AGAGAUGGUUGGAUGGAcAdTsdT | antis |
| 1495-1514 | 3833 | CAUCUCUCAAUGCCAUUCU | 3834 | cAucucucAAuGccAuucudTsdT | sense |
| 1495-1514 | 3835 | AGAAUGGCAUUGAGAGAUG | 3836 | AGAAUGGcAUUGAGAGAUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
| --- | --- | --- | --- | --- | --- |
| 1554-1573 | 3837 | CCCCUCACCACUUCCUACA | 3838 | ccccucAccAcuuccuAcdTsdT | sense |
| 1554-1573 | 3839 | UGUAGGAAGUGGUGAGGGG | 3840 | UGuAGGAAGUGGUGAGGGGdTsdT | antis |
| 1597-1616 | 3841 | AAGCUCAGACUGGCCAAGA | 3842 | AAGcucAGAcuGGccAAGAdTsdT | sense |
| 1597-1616 | 3843 | UCUUGGCCAGUCUGAGCUU | 3844 | UCUUGGCcAGUCUGAGCUUdTsdT | antis |
| 1659-1678 | 3845 | UCCUGAGGGCCCCACCGAC | 3846 | uccuGAGGGccccAccGAcdTsdT | sense |
| 1659-1678 | 3847 | GUCGGUGGGGCCCUCAGGA | 3848 | GUCGGUGGGGCCCUcAGGAdTsdT | antis |
| 1814-1833 | 3849 | CAGCAGCCUAACCUCUGUG | 3850 | cAGcAGccuAAccucuGuGdTsdT | sense |
| 1814-1833 | 3851 | CACAGAGGUUAGGCUGCUG | 3852 | cAcAGAGGUuAGGCUGCUGdTsdT | antis |
| 1815-1834 | 3853 | AGCAGCCUAACCUCUGUGG | 3854 | AGcAGccuAAccucuGuGGdTsdT | sense |
| 1815-1834 | 3855 | CCACAGAGGUUAGGCUGCU | 3856 | CcAcAGAGGUuAGGCUGCUdTsdT | antis |
| 1904-1923 | 3857 | UGAGGACCUUCUACCCCCU | 3858 | uGAGGAccuucuAcccccudTsdT | sense |
| 1904-1923 | 3859 | AGGGGGUAGAAGGUCCUCA | 3860 | AGGGGGuAGAAGGUCCUcAdTsdT | antis |
| 1905-1924 | 3861 | GAGGACCUUCUACCCCCUU | 3862 | GAGGAccuucuAcccccuudTsdT | sense |
| 1905-1924 | 3863 | AAGGGGGUAGAAGGUCCUC | 3864 | AAGGGGGuAGAAGGUCCUCdTsdT | antis |
| 2012-2031 | 3865 | GUCUUCCCUUCCCUGGCCC | 3866 | GucuucccuucccuGGcccdTsdT | sense |
| 2012-2031 | 3867 | GGGCCAGGGAAGGGAAGAC | 3868 | GGGCcAGGGAAGGGAAGACdTsdT | antis |
| 2095-2114 | 3869 | UGCCCCCCCCAGCUGUACC | 3870 | uGccccccccAGcuGuAccdTsdT | sense |
| 2095-2114 | 3871 | GGUACAGCUGGGGGGGGCA | 3872 | GGuAcAGCUGGGGGGGGcAdTsdT | antis |
| 2102-2121 | 3873 | CCCAGCUGUACCCCUUCUU | 3874 | cccAGcuGuAccccuucuudTsdT | sense |
| 2102-2121 | 3875 | AAGAAGGGGUACAGCUGGG | 3876 | AAGAAGGGGuAcAGCUGGGdTsdT | antis |
| 2184-2203 | 3877 | CUGGUGUCUUAGUUCCAC | 3878 | cuGGuGucuuAGuuccAcdTsdT | sense |
| 2184-2203 | 3879 | GUGGAAACUAAGACACCAG | 3880 | GUGGAAACuAAGAcACcAGdTsdT | antis |
| 2192-2211 | 3881 | UUAGUUCCACAGUAAGGU | 3882 | uuAGuuccAcAGuAAGGudTsdT | sense |
| 2192-2211 | 3883 | ACCUUACUGUGGAAACUAA | 3884 | ACCUuACUGUGGAAACuAAdTsdT | antis |
| 2227-2246 | 3885 | CUCUGUUCAAUAAAUUAUU | 3886 | cucuGuucAAuAAAuuAuudTsdT | sense |
| 2227-2246 | 3887 | AAUAAUUUAUUGAACAGAG | 3888 | AAuAAUUuAUUGAAcAGAGdTsdT | antis |
| 151-170 | 3889 | AGGCAGCCCGAGCCCCGCG | 3890 | AGGcAGcccGAGccccGcGdTsdT | sense |
| 151-170 | 3891 | CGCGGGGCUCGGGCUGCCU | 3892 | CGCGGGGCUCGGGCUGCCUdTsdT | antis |
| 404-423 | 3893 | CAGCGGCGGAGGAGGCAGC | 3894 | cAgcGGcGGAGGAGGcAGcdTsdT | sense |
| 404-423 | 3895 | GCUGCCUCCUCCGCCGCUG | 3896 | GCUGCCUCCUCCGCCGCUGdTsdT | antis |
| 530-549 | 3897 | UUCCCAAGAAGUGGCUUAC | 3898 | uucccAAGAAGuGGcuuAcdTsdT | sense |
| 530-549 | 3899 | GUAAGCCACUUCUUGGGAA | 3900 | GuAAGCcACUUCUUGGGAAdTsdT | antis |
| 954-973 | 3901 | GACACUGCUGUCCUCAAGC | 3902 | GAcAcUGcuGuccucAAGcdTsdT | sense |
| 954-973 | 3903 | GCUUGAGGACAGCAGUGUC | 3904 | GCUUGAGGAcAGcAGUGUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1394-1413 | 3905 | CAGCUUCUUCGAUGAACUG | 3906 | cAGcuucuucGAuGAAcuGdTsdT | sense |
| 1394-1413 | 3907 | CAGUUCAUCGAAGAAGCUG | 3908 | cAGUUcAUCGAAGAAGCUGdTsdT | antis |
| 2002-2021 | 3909 | CCCAUCUCUCGUCUUCCCU | 3910 | cccAucucucGucuucccudTsdT | sense |
| 2002-2021 | 3911 | AGGGAAGACGAGAGAUGGG | 3912 | AGGGAAGACGAGAGAUGGGdTsdT | antis |
| 2003-2022 | 3913 | CCAUCUCUCGUCUUCCCUU | 3914 | ccAucucucGucuucccuudTsdT | sense |
| 2003-2022 | 3915 | AAGGGAAGACGAGAGAUGG | 3916 | AAGGGAAGACGAGAGAUGGdTsdT | antis |
| 2121-2140 | 3917 | GUCCUCUGCUCCCAAGGCU | 3918 | GuccucuGcuccCAAGGcudTsdT | sense |
| 2121-2140 | 3919 | AGCCUUGGGAGCAGAGGAC | 3920 | AGCCUUGGGAGcAGAGGACdTsdT | antis |
| 24-43 | 3921 | AGAGGGACUUCAUCUCCCG | 3922 | AGAGGGAcuucAucucccGdTsdT | sense |
| 24-43 | 3923 | CGGGAGAUGAAGUCCCUCU | 3924 | CGGGAGAUGAAGUCCCUCUdTsdT | antis |
| 49-68 | 3925 | CCCGCGGCGGGCGCUGGGC | 3926 | cccGcGGcGGGcGcuGGGcdTsdT | sense |
| 49-68 | 3927 | GCCCAGCGCCCGCCGCGGG | 3928 | GCCcAGCGCCCGCCGCGGGdTsdT | antis |
| 107-126 | 3929 | GAGCCCAGGGGAGGCGGCG | 3930 | GAGcccAGGGGAGGcGGcGdTsdT | sense |
| 107-126 | 3931 | CGCCGCCUCCCCUGGGCUC | 3932 | CGCCGCCUCCCCUGGGCUCdTsdT | antis |
| 126-145 | 3933 | GCAGAGGCAGCGGCGGGGG | 3934 | GcAGAGGcAGcGGcGGGGGdTsdT | sense |
| 126-145 | 3935 | CCCCCGCCGCUGCCUCUGC | 3936 | CCCCCGCCGCUGCCUCUGCdTsdT | antis |
| 153-172 | 3937 | GCAGCCCGAGCCCCGCGGC | 3938 | GcAGcccGAGccccGcGGcdTsdT | sense |
| 153-172 | 3939 | GCCGCGGGGCUCGGGCUGC | 3940 | GCCGCGGGGCUCGGGCUGCdTsdT | antis |
| 259-278 | 3941 | CGGAGCCAGGAGGCGGAGG | 3942 | cGGAGccAGGAGGcGGAGGdTsdT | sense |
| 259-278 | 3943 | CCUCCGCCUCCUGGCUCCG | 3944 | CCUCCGCCUCCUGGCUCCGdTsdT | antis |
| 261-280 | 3945 | GAGCCAGGAGGCGGAGGCG | 3946 | GAGccAGGAGGcGGAGGcGdTsdT | sense |
| 261-280 | 3947 | CGCCUCCGCCUCCUGGCUC | 3948 | CGCCUCCGCCUCCUGGCUCdTsdT | antis |
| 512-531 | 3949 | AGGCCAAGGCCCAGAGCGU | 3950 | AGGccAAGGcccAGAGcGudTsdT | sense |
| 512-531 | 3951 | ACGCUCUGGGCCUUGGCCU | 3952 | ACGCUCUGGGCCUUGGCCUdTsdT | antis |
| 660-679 | 3953 | AAGAACCGAGAACUGCAGA | 3954 | AAGAAccGAGAAcuGcAGAdTsdT | sense |
| 660-679 | 3955 | UCUGCAGUUCUCGGUUCUU | 3956 | UCUGcAGUUCUCGGUUCUUdTsdT | antis |
| 709-728 | 3957 | UGAGGCUGCGGUACUUUUU | 3958 | uGAGGcuGcGGuAcuuuuudTsdT | sense |
| 709-728 | 3959 | AAAAAGUACCGCAGCCUCA | 3960 | AAAAAGuACCGcAGCCUcAdTsdT | antis |
| 710-729 | 3961 | GAGGCUGCGGUACUUUUUC | 3962 | GAGGcuGcGGuAcuuuuucdTsdT | sense |
| 710-729 | 3963 | GAAAAGUACCGCAGCCUC | 3964 | GAAAAGuACCGcAGCCUCdTsdT | antis |
| 792-811 | 3965 | ACGGUGUACCGAGUGGGCCC | 3966 | AcGGuGuAccGAGuGGcccdTsdT | sense |
| 792-811 | 3967 | GGGCCACUCGGUACACCGU | 3968 | GGGCcACUCGGuAcACCGUdTsdT | antis |
| 903-922 | 3969 | CAAGGUGUGUGUCACCGUG | 3970 | cAAGGuGuGuGucAccGuGdTsdT | sense |
| 903-922 | 3971 | CACGGUGACACACACCUUG | 3972 | cACGGUGAcAcAcACCUUGdTsdT | antis |
| 1110-1129 | 3973 | GGCUGUGUACUUGCUGAGC | 3974 | GGcuGuGuAcuuGcuGAGcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1110-1129 | 3975 | GCUCAGCAAGUACACAGCC | 3976 | GCUcAGcAAGuAcAcAGCCdTsdT | antis |
| 1129-1148 | 3977 | UACUUCUCGGCCAGCCCAU | 3978 | uAcuucucGGccAGcccAudTsdT | sense |
| 1129-1148 | 3979 | AUGGGCUGGCCGAGAAGUA | 3980 | AUGGGCUGGCCGAGAAGuAdTsdT | antis |
| 1142-1161 | 3981 | GCCCAUCUUCCCUGGGGAC | 3982 | GcccAucuucccuGGGGAcdTsdT | sense |
| 1142-1161 | 3983 | GUCCCCAGGGAAGAUGGGC | 3984 | GUCCCcAGGGAAGAUGGGCdTsdT | antis |
| 1153-1172 | 3985 | CUGGGGACAGUGGGGUGGA | 3986 | cuGGGGAcAGuGGGGuGGAdTsdT | sense |
| 1153-1172 | 3987 | UCCACCCCACUGUCCCCAG | 3988 | UCcACCCcACUGUCCCcAGdTsdT | antis |
| 1472-1491 | 3989 | UCCUGGUGAACUGUCCAUC | 3990 | uccuGGuGAAcuGuccAucdTsdT | sense |
| 1472-1491 | 3991 | GAUGGACAGUUCACCAGGA | 3992 | GAUGGAcAGUUcACcAGGAdTsdT | antis |
| 1473-1492 | 3993 | CCUGGUGAACUGUCCAUCC | 3994 | ccuGGuGAAcuGuccAuccdTsdT | sense |
| 1473-1492 | 3995 | GGAUGGACAGUUCACCAGG | 3996 | GGAUGGAcAGUUcACcAGGdTsdT | antis |
| 1652-1671 | 3997 | UAGCUCUUCCUGAGGGCCC | 3998 | uAGcucuuccuGAGGGcccdTsdT | sense |
| 1652-1671 | 3999 | GGGCCCUCAGGAAGAGCUA | 4000 | GGGCCCUcAGGAAGAGCuAdTsdT | antis |
| 1653-1672 | 4001 | AGCUCUUCCUGAGGGCCCC | 4002 | AGcucuuccuGAGGGccccdTsdT | sense |
| 1653-1672 | 4003 | GGGGCCCUCAGGAAGAGCU | 4004 | GGGGCCCUcAGGAAGAGCUdTsdT | antis |
| 1812-1831 | 4005 | CUCAGCAGCCUAACCUCUG | 4006 | cucAGcAGccuAAccucuGdTsdT | sense |
| 1812-1831 | 4007 | CAGAGGUUAGGCUGCUGAG | 4008 | cAGAGGUuAGGCUGCUGAGdTsdT | antis |
| 1952-1971 | 4009 | UCCUUCCCUCCCCCCCUCU | 4010 | uccuucccuccccccucudTsdT | sense |
| 1952-1971 | 4011 | AGAGGGGGGAGGGAAGGA | 4012 | AGAGGGGGGAGGGAAGGAdTsdT | antis |
| 1968-1987 | 4013 | UCUCCCAGGUCCCUUGUAA | 4014 | ucucccAGGucccuuGuAAdTsdT | sense |
| 1968-1987 | 4015 | UUACAAGGGACCUGGGAGA | 4016 | UuAcAAGGGACCUGGGAGAdTsdT | antis |
| 2051-2070 | 4017 | UAUAAUUUUUUCUUAAAGA | 4018 | uAuAAuuuuuucuuAAAGAdTsdT | sense |
| 2051-2070 | 4019 | UCUUUAAGAAAAAAUUAUA | 4020 | UCUUuAAGAAAAAAUuAuAdTsdT | antis |
| 2056-2075 | 4021 | UUUUUUCUUAAAGAAAACG | 4022 | uuuuuucuuAAAGAAAAcGdTsdT | sense |
| 2056-2075 | 4023 | CGUUUUCUUUAAGAAAAAA | 4024 | CGUUUUCUUuAAGAAAAAAdTsdT | antis |
| 2128-2147 | 4025 | GCUCCCAAGGCUUCCUCCC | 4026 | GcucccAAGGcuuccucccdTsdT | sense |
| 2128-2147 | 4027 | GGGAGGAAGCCUUGGGAGC | 4028 | GGGAGGAAGCCUUGGGAGCdTsdT | antis |
| 2135-2154 | 4029 | AGGCUUCCUCCCUCUCCCC | 4030 | AGGcuuccucccucucccdTsdT | sense |
| 2135-2154 | 4031 | GGGGAGAGGGAGGAAGCCU | 4032 | GGGGAGAGGGAGGAAGCCUdTsdT | antis |
| 2136-2155 | 4033 | GGCUUCCUCCCUCUCCCCA | 4034 | GGcuuccucccucuccccAdTsdT | sense |
| 2136-2155 | 4035 | UGGGGAGAGGGAGGAAGCC | 4036 | UGGGGAGAGGGAGGAAGCCdTsdT | antis |
| 2147-2166 | 4037 | UCUCCCCAUCCUGGAAGGA | 4038 | ucuccccAuccuGGAAGGAdTsdT | sense |
| 2147-2166 | 4039 | UCCUUCCAGGAUGGGGAGA | 4040 | UCCUUCcAGGAUGGGGAGAdTsdT | antis |
| 511-530 | 4041 | UAGGCCAAGGCCCAGAGCG | 4042 | uAGGccAAGGcccAGAGcGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 511-530 | 4043 | CGCUCUGGGCCUUGGCCUA | 4044 | CGCUCUGGGCCUUGGCCUAdTsdT | antis |
| 677-696 | 4045 | GAUUAUGCGUAAGCUGGAC | 4046 | GAuuAuGcGuAAGcuGGAcdTsdT | sense |
| 677-696 | 4047 | GUCCAGCUUACGCAUAAUC | 4048 | GUCcAGCUuACGcAuAAUCdTsdT | antis |
| 682-701 | 4049 | UGCGUAAGCUGGACCACUG | 4050 | uGcGuAAGcuGGAccAcuGdTsdT | sense |
| 682-701 | 4051 | CAGUGGUCCAGCUUACGCA | 4052 | cAGUGGUCcAGCUuACGcAdTsdT | antis |
| 796-815 | 4053 | UGUACCGAGUGGCCCGCCA | 4054 | uGuAccGAGuGGcccGccAdTsdT | sense |
| 796-815 | 4055 | UGGCGGGCCACUCGGUACA | 4056 | UGGCGGGCcACUCGGuAcAdTsdT | antis |
| 750-769 | 4057 | GACGAGCUGUAUUUGAAUC | 4058 | GAcGAGcuGuAuuuGAAucdTsdT | sense |
| 750-769 | 4059 | GAUUCAAAUACAGCUCGUC | 4060 | GAUUcAAAuAcAGCUCGUCdTsdT | antis |
| 1646-1665 | 4061 | CCUCGCUAGCUCUUCCUGA | 4062 | ccucGcuAGcucuuccuGAdTsdT | sense |
| 1646-1665 | 4063 | UCAGGAAGAGCUAGCGAGG | 4064 | UcAGGAAGAGCuAGCGAGGdTsdT | antis |
| 664-683 | 4065 | ACCGAGAACUGCAGAUUAU | 4066 | AccGAGAAcuGcAGAuuAudTsdT | sense |
| 664-683 | 4067 | AUAAUCUGCAGUUCUCGGU | 4068 | AuAAUCUGcAGUUCUCGGUdTsdT | antis |
| 751-770 | 4069 | ACGAGCUGUAUUUGAAUCU | 4070 | AcGAGcuGuAuuuGAAucudTsdT | sense |
| 751-770 | 4071 | AGAUUCAAAUACAGCUCGU | 4072 | AGAUUcAAAuAcAGCUCGUdTsdT | antis |
| 835-854 | 4073 | UCACCCCUAUCAUCUACAU | 4074 | ucAccccuAucAucuAcAudTsdT | sense |
| 835-854 | 4075 | AUGUAGAUGAUAGGGGUGA | 4076 | AUGuAGAUGAuAGGGGUGAdTsdT | antis |
| 1399-1418 | 4077 | UCUUCGAUGAACUGCGGAG | 4078 | ucuucGAuGAAcuGcGGAGdTsdT | sense |
| 1399-1418 | 4079 | CUCCGCAGUUCAUCGAAGA | 4080 | CUCCGcAGUUcAUCGAAGAdTsdT | antis |
| 2175-2194 | 4081 | AGAGAGUCCCUGGGUGUCUU | 4082 | AGAGAGucccuGGuGucuudTsdT | sense |
| 2175-2194 | 4083 | AAGACACCAGGGACUCUCU | 4084 | AAGAcAccAGGGACUCUCUdTsdT | antis |
| 19-38 | 4085 | ACGGCAGAGGGACUUCAUC | 4086 | AcGGcAGAGGGAcuucAucdTsdT | sense |
| 19-38 | 4087 | GAUGAAGUCCCUCUGCCGU | 4088 | GAUGAAGUCCCUCUGCCGUdTsdT | antis |
| 79-98 | 4089 | CCCGAACGGCGCGGCCUGG | 4090 | cccGAAcGGcGcGGccuGGdTsdT | sense |
| 79-98 | 4091 | CCAGGCCGCGCCGUUCGGG | 4092 | CcAGGCCGCGCCGUUCGGGdTsdT | antis |
| 186-205 | 4093 | GGCGCCAUGAGCGGCGGCG | 4094 | GGcGccAuGAGcGGcGGcGdTsdT | sense |
| 186-205 | 4095 | CGCCGCCGCUCAUGGCGCC | 4096 | CGCCGCCGCUcAUGGCGCCdTsdT | antis |
| 187-206 | 4097 | GCGCCAUGAGCGGCGGCGG | 4098 | GcGccAuGAGcGGcGGcGGdTsdT | sense |
| 187-206 | 4099 | CCGCCGCCGCUCAUGGCGC | 4100 | CCGCCGCCGCUcAUGGCGCdTsdT | antis |
| 334-353 | 4101 | GCGGGAAAGCGUCAGUCGG | 4102 | GcGGGAAAGcGucAGucGGdTsdT | sense |
| 334-353 | 4103 | CCGACUGACGCUUUCCCGC | 4104 | CCGACUGACGCUUUCCCGCdTsdT | antis |
| 349-368 | 4105 | UCGGGGCUAUGGGUGGGGG | 4106 | ucGGGGcuAuGGGuGGGGGdTsdT | sense |
| 349-368 | 4107 | CCCCCACCCAUAGCCCCGA | 4108 | CCCCcACCcAuAGCCCCGAdTsdT | antis |
| 451-470 | 4109 | CGCCGCCGGGAGUGAAGCU | 4110 | cGccGccGGGAGuGAAGcudTsdT | sense |
| 451-470 | 4111 | AGCUUCACUCCCGGCGGCG | 4112 | AGCUUcACUCCCGGCGGCGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 476-495 | 4113 | UGACAGCGGGAAGGUGACC | 4114 | uGAcAGcGGGAAGGuGAccdTsdT | sense |
| 476-495 | 4115 | GGUCACCUUCCCGCUGUCA | 4116 | GGUcACCUUCCCGCUGUcAdTsdT | antis |
| 480-499 | 4117 | AGCGGGAAGGUGACCACAG | 4118 | AGcGGGAAGGuGAccAcAGdTsdT | sense |
| 480-499 | 4119 | CUGUGGUCACCUUCCCGCU | 4120 | CUGUGGUcACCUUCCCGCUdTsdT | antis |
| 481-500 | 4121 | GCGGGAAGGUGACCACAGU | 4122 | GcGGGAAGGuGAccAcAGudTsdT | sense |
| 481-500 | 4123 | ACUGUGGUCACCUUCCCGC | 4124 | ACUGUGGUcACCUUCCCGCdTsdT | antis |
| 516-535 | 4125 | CAAGGCCCAGAGCGUUCCC | 4126 | cAAGGcccAGAGcGuucccdTsdT | sense |
| 516-535 | 4127 | GGGAACGCUCUGGGCCUUG | 4128 | GGGAACGCUCUGGGCCUUGdTsdT | antis |
| 586-605 | 4129 | UAGUAUACCAGGCACGGCU | 4130 | uAGuAuAccAGGcAcGGcudTsdT | sense |
| 586-605 | 4131 | AGCCGUGCCUGGUAUACUA | 4132 | AGCCGUGCCUGGuAuAcuAdTsdT | antis |
| 608-627 | 4133 | AGAGACGAGGGAACUGGUG | 4134 | AGAGAcGAGGGAAcuGGuGdTsdT | sense |
| 608-627 | 4135 | CACCAGUUCCCUCGUCUCU | 4136 | cAccAGUUCCCUCGUCUCUdTsdT | antis |
| 662-681 | 4137 | GAACCGAGAACUGCAGAUU | 4138 | GAAccGAGAAcuGcAGAuudTsdT | sense |
| 662-681 | 4139 | AAUCUGCAGUUCUCGGUUC | 4140 | AAUCUGcAGUUCUCGGUUCdTsdT | antis |
| 678-697 | 4141 | AUUAUGCGUAAGCUGGACC | 4142 | AuuAuGcGuAAGcuGGAccdTsdT | sense |
| 678-697 | 4143 | GGUCCAGCUUACGCAUAAU | 4144 | GGUCcAGCUuACGcAuAAUdTsdT | antis |
| 679-698 | 4145 | UUAUGCGUAAGCUGGACCA | 4146 | uuAuGcGuAAGcuGGAccAdTsdT | sense |
| 679-698 | 4147 | UGGUCCAGCUUACGCAUAA | 4148 | UGGUCcAGCUuACGcAuAAdTsdT | antis |
| 680-699 | 4149 | UAUGCGUAAGCUGGACCAC | 4150 | uAuGcGuAAGcuGGAccAcdTsdT | sense |
| 680-699 | 4151 | GUGGUCCAGCUUACGCAUA | 4152 | GUGGUCcAGCUuACGcAuAdTsdT | antis |
| 683-702 | 4153 | GCGUAAGCUGGACCACUGC | 4154 | GcGuAAGcuGGAccAcuGcdTsdT | sense |
| 683-702 | 4155 | GCAGUGGUCCAGCUUACGC | 4156 | GcAGUGGUCcAGCUuACGCdTsdT | antis |
| 714-733 | 4157 | CUGCGGUACUUUUUCUACU | 4158 | cuGcGGuAcuuuuucuAcudTsdT | sense |
| 714-733 | 4159 | AGUAGAAAAAGUACCGCAG | 4160 | AGuAGAAAAAGuACCGcAGdTsdT | antis |
| 715-734 | 4161 | UGCGGUACUUUUUCUACUC | 4162 | uGcGGuAcuuuuucuAcucdTsdT | sense |
| 715-734 | 4163 | GAGUAGAAAAAGUACCGCA | 4164 | GAGuAGAAAAAGuACCGcAdTsdT | antis |
| 754-773 | 4165 | AGCUGUAUUUGAAUCUGGU | 4166 | AGcuGuAuuuGAAucuGGudTsdT | sense |
| 754-773 | 4167 | ACCAGAUUCAAAUACAGCU | 4168 | ACcAGAUUcAAAuAcAGCUdTsdT | antis |
| 795-814 | 4169 | GUGUACCGAGUGGCCCGCC | 4170 | GuGuAccGAGuGGcccGccdTsdT | sense |
| 795-814 | 4171 | GGCGGGCCACUCGGUACAC | 4172 | GGCGGGCcACUCGGuAcACdTsdT | antis |
| 797-816 | 4173 | GUACCGAGUGGCCCGCCAC | 4174 | GuAccGAGuGGcccGccAcdTsdT | sense |
| 797-816 | 4175 | GUGGCGGGCCACUCGGUAC | 4176 | GUGGCGGGCcACUCGGuACdTsdT | antis |
| 799-818 | 4177 | ACCGAGUGGCCCGCCACUU | 4178 | AccGAGuGGcccGccAcuudTsdT | sense |
| 799-818 | 4179 | AAGUGGCGGGCCACUCGGU | 4180 | AAGUGGCGGGCcACUCGGUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 800-819 | 4181 | CCGAGUGGCCCGCCACUUC | 4182 | ccGAGuGGcccGccAcuucdTsdT | sense |
| 800-819 | 4183 | GAAGUGGCGGGCCACUCGG | 4184 | GAAGUGGCGGGCcACUCGGdTsdT | antis |
| 834-853 | 4185 | AUCACCCCUAUCAUCUACA | 4186 | AucAccccuAucAucuAcAdTsdT | sense |
| 834-853 | 4187 | UGUAGAUGAUAGGGGUGAU | 4188 | UGuAGAUGAuAGGGGUGAUdTsdT | antis |
| 845-864 | 4189 | CAUCUACAUCAAGGUGUAC | 4190 | cAucuAcAucAAGGuGuAcdTsdT | sense |
| 845-864 | 4191 | GUACACCUUGAUGUAGAUG | 4192 | GuAcACCUUGAUGuAGAUGdTsdT | antis |
| 850-869 | 4193 | ACAUCAAGGUGUACAUGUA | 4194 | AcAucAAGGuGuAcAuGuAdTsdT | sense |
| 850-869 | 4195 | UACAUGUACACCUUGAUGU | 4196 | uAcAUGuAcACCUUGAUGUdTsdT | antis |
| 885-904 | 4197 | UUGGCCUACAUCCACUCCC | 4198 | uuGGccuAcAuccAcucccdTsdT | sense |
| 885-904 | 4199 | GGGAGUGGAUGUAGGCCAA | 4200 | GGGAGUGGAUGuAGGCcAAdTsdT | antis |
| 890-909 | 4201 | CUACAUCCACUCCCAAGGU | 4202 | cuAcAuccAcucccAAGGudTsdT | sense |
| 890-909 | 4203 | ACCUUGGGAGUGGAUGUAG | 4204 | ACCUUGGGAGUGGAUGuAGdTsdT | antis |
| 921-940 | 4205 | GACAUCAAGCCCCAGAAUU | 4206 | GAcAucAAGccccAGAAuudTsdT | sense |
| 921-940 | 4207 | AAUUCUGGGGCUUGAUGUC | 4208 | AAUUCUGGGGCUUGAUGUCdTsdT | antis |
| 934-953 | 4209 | AGAAUUUGCUUGUGGACCC | 4210 | AGAAuuuGcuuGuGGAcccdTsdT | sense |
| 934-953 | 4211 | GGGUCCACAAGCAAAUUCU | 4212 | GGGUCcAcAAGcAAAUUCUdTsdT | antis |
| 1032-1051 | 4213 | UGCUCUCGGUACUACCGUG | 4214 | uGcucucGGuAcuAccGuGdTsdT | sense |
| 1032-1051 | 4215 | CACGGUAGUACCGAGAGCA | 4216 | cACGGuAGuACCGAGAGcAdTsdT | antis |
| 1033-1052 | 4217 | GCUCUCGGUACUACCGUGC | 4218 | GcucucGGuAcuAccGuGcdTsdT | sense |
| 1033-1052 | 4219 | GCACGGUAGUACCGAGAGC | 4220 | GcACGGuAGuACCGAGAGCdTsdT | antis |
| 1081-1100 | 4221 | ACACCUCGUCCAUCGAUGU | 4222 | AcAccucGuccAucGAuGudTsdT | sense |
| 1081-1100 | 4223 | ACAUCGAUGGACGAGGUGU | 4224 | AcAUCGAUGGACGAGGUGUdTsdT | antis |
| 1082-1101 | 4225 | CACCUCGUCCAUCGAUGUG | 4226 | cAccucGuccAucGAuGuGdTsdT | sense |
| 1082-1101 | 4227 | CACAUCGAUGGACGAGGUG | 4228 | cAcAUCGAUGGACGAGGUGdTsdT | antis |
| 1083-1102 | 4229 | ACCUCGUCCAUCGAUGUGU | 4230 | AccucGuccAucGAuGuGudTsdT | sense |
| 1083-1102 | 4231 | ACACAUCGAUGGACGAGGU | 4232 | AcAcAUCGAUGGACGAGGUdTsdT | antis |
| 1241-1260 | 4233 | CUAUACGGAGUUCAAGUUC | 4234 | cuAuAcGGAGuucAAGuucdTsdT | sense |
| 1241-1260 | 4235 | GAACUUGAACUCCGUAUAG | 4236 | GAACUUGAACUCCGuAuAGdTsdT | antis |
| 1242-1261 | 4237 | UAUACGGAGUUCAAGUUCC | 4238 | uAuAcGGAGuucAAGuuccdTsdT | sense |
| 1242-1261 | 4239 | GGAACUUGAACUCCGUAUA | 4240 | GGAACUUGAACUCCGuAuAdTsdT | antis |
| 1243-1262 | 4241 | AUACGGAGUUCAAGUUCCC | 4242 | AuAcGGAGuucAAGuucccdTsdT | sense |
| 1243-1262 | 4243 | GGGAACUUGAACUCCGUAU | 4244 | GGGAACUUGAACUCCGuAUdTsdT | antis |
| 1396-1415 | 4245 | GCUUCUUCGAUGAACUGCG | 4246 | GcuucuucGAuGAAcuGcGdTsdT | sense |
| 1396-1415 | 4247 | CGCAGUUCAUCGAAGAAGC | 4248 | CGcAGUUcAUCGAAGAAGCdTsdT | antis |
| 1397-1416 | 4249 | CUUCUUCGAUGAACUGCGG | 4250 | cuucuucGAuGAAcuGcGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1397-1416 | 4251 | CCGCAGUUCAUCGAAGAAG | 4252 | CCGcAGUUcAUCGAAGAAGdTsdT | antis |
| 1398-1417 | 4253 | UUCUUCGAUGAACUGCGGA | 4254 | uucuucGAuGAAcuGcGGAdTsdT | sense |
| 1398-1417 | 4255 | UCCGCAGUUCAUCGAAGAA | 4256 | UCCGcAGUUcAUCGAAGAAdTsdT | antis |
| 1400-1419 | 4257 | CUUCGAUGAACUGCGGAGA | 4258 | cuucGAuGAAcuGcGGAGAdTsdT | sense |
| 1400-1419 | 4259 | UCUCCGCAGUUCAUCGAAG | 4260 | UCUCCGcAGUUcAUCGAAGdTsdT | antis |
| 1452-1471 | 4261 | CCCCCCCUGUUCAACUUCA | 4262 | cccccccuGuucAAcuucAdTsdT | sense |
| 1452-1471 | 4263 | UGAAGUUGAACAGGGGGGG | 4264 | UGAAGUUGAAcAGGGGGGGdTsdT | antis |
| 1576-1595 | 4265 | CAUCCUCACAAGCUUUAAC | 4266 | cAuccucAcAAGcuuuAAcdTsdT | sense |
| 1576-1595 | 4267 | GUUAAAGCUUGUGAGGAUG | 4268 | GUuAAAGCUUGUGAGGAUGdTsdT | antis |
| 1634-1653 | 4269 | CACAACUGCUACCCUCGCU | 4270 | cAcAAcuGcuAcccucGcudTsdT | sense |
| 1634-1653 | 4271 | AGCGAGGGUAGCAGUUGUG | 4272 | AGCGAGGGuAGcAGUUGUGdTsdT | antis |
| 1635-1654 | 4273 | ACAACUGCUACCCUCGCUA | 4274 | AcAAcuGcuAcccucGcuAdTsdT | sense |
| 1635-1654 | 4275 | UAGCGAGGGUAGCAGUUGU | 4276 | uAGCGAGGGuAGcAGUUGUdTsdT | antis |
| 1643-1662 | 4277 | UACCCUCGCUAGCUCUUCC | 4278 | uAcccucGcuAGcucuucedTsdT | sense |
| 1643-1662 | 4279 | GGAAGAGCUAGCGAGGGUA | 4280 | GGAAGAGCuAGCGAGGGuAdTsdT | antis |
| 1645-1664 | 4281 | CCCUCGCUAGCUCUUCCUG | 4282 | cccucGcuAGcucuuccuGdTsdT | sense |
| 1645-1664 | 4283 | CAGGAAGAGCUAGCGAGGG | 4284 | cAGGAAGAGCuAGCGAGGGdTsdT | antis |
| 1660-1679 | 4285 | CCUGAGGGCCCCACCGACU | 4286 | ccuGAGGGccccAccGAcudTsdT | sense |
| 1660-1679 | 4287 | AGUCGGUGGGGCCCUCAGG | 4288 | AGUCGGUGGGGCCCUcAGGdTsdT | antis |
| 1664-1683 | 4289 | AGGGCCCCACCGACUACCC | 4290 | AGGGccccAccGAcuAcccdTsdT | sense |
| 1664-1683 | 4291 | GGGUAGUCGGUGGGGCCCU | 4292 | GGGuAGUCGGUGGGGCCCUdTsdT | antis |
| 1665-1684 | 4293 | GGGCCCCACCGACUACCCC | 4294 | GGGccccAccGAcuAccccdTsdT | sense |
| 1665-1684 | 4295 | GGGGUAGUCGGUGGGGCCC | 4296 | GGGGuAGUCGGUGGGGCCCdTsdT | antis |
| 1816-1835 | 4297 | GCAGCCUAACCUCUGUGGU | 4298 | GcAGccuAAccucuGuGGudTsdT | sense |
| 1816-1835 | 4299 | ACCACAGAGGUUAGGCUGC | 4300 | ACcAcAGAGGUuAGGCUGCdTsdT | antis |
| 1817-1836 | 4301 | CAGCCUAACCUCUGUGGUG | 4302 | cAGccuAAccucuGuGGuGdTsdT | sense |
| 1817-1836 | 4303 | CACCACAGAGGUUAGGCUG | 4304 | cACcAcAGAGGUuAGGCUGdTsdT | antis |
| 1973-1992 | 4305 | CAGGUCCCUUGUAAAUAGA | 4306 | cAGGucccuuGuAAAuAGAdTsdT | sense |
| 1973-1992 | 4307 | UCUAUUUACAAGGGACCUG | 4308 | UCuAUUuAcAAGGGACCUGdTsdT | antis |
| 2206-2225 | 4309 | AAGGUUUGCCUGUGUACAG | 4310 | AAGGuuuGccuGuGuAcAGdTsdT | sense |
| 2206-2225 | 4311 | CUGUACACAGGCAAACCUU | 4312 | CUGuAcAcAGGcAAACCUUdTsdT | antis |
| 2207-2226 | 4313 | AGGUUUGCCUGUGUACAGA | 4314 | AGGuuuGccuGuGuAcAGAdTsdT | sense |
| 2207-2226 | 4315 | UCUGUACACAGGCAAACCU | 4316 | UCUGuAcAcAGGcAAACCUdTsdT | antis |
| 2222-2241 | 4317 | CAGACCUCUGUUCAAUAAA | 4318 | cAGAccucuGuucAAuAAAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2222-2241 | 4319 | UUUAUUGAACAGAGGUCUG | 4320 | UUuAUUGAcAGAGGUCUGdTsdT | antis |
| 542-561 | 4321 | GGCUUACACUGACAUCAAA | 4322 | GGcuuAcAcuGAcAucAAAdTsdT | sense |
| 542-561 | 4323 | UUUGAUGUCAGUGUAAGCC | 4324 | UUUGAUGUcAGUGuAAGCCdTsdT | antis |
| 681-700 | 4325 | AUGCGUAAGCUGGACCACU | 4326 | AuGcGuAAGcuGGAccAcudTsdT | sense |
| 681-700 | 4327 | AGUGGUCCAGCUUACGCAU | 4328 | AGUGGUCcAGCUuACGcAUdTsdT | antis |
| 748-767 | 4329 | AGGACGAGCUGUAUUUGAA | 4330 | AGGAcGAGcuGuAuuuGAAdTsdT | sense |
| 748-767 | 4331 | UUCAAAUACAGCUCGUCCU | 4332 | UUcAAAuAcAGCUCGUCCUdTsdT | antis |
| 749-768 | 4333 | GGACGAGCUGUAUUUGAAU | 4334 | GGAcGAGcuGuAuuuGAAudTsdT | sense |
| 749-768 | 4335 | AUUCAAAUACAGCUCGUCC | 4336 | AUUcAAAuAcAGCUCGUCCdTsdT | antis |
| 1352-1371 | 4337 | CACGCCAUCCUCAAGGCUC | 4338 | cAcGccAuccucAAGGcucdTsdT | sense |
| 1352-1371 | 4339 | GAGCCUUGAGGAUGGCGUG | 4340 | GAGCCUUGAGGAUGGCGUGdTsdT | antis |
| 1944-1963 | 4341 | GCUACCACUCCUUCCCUCC | 4342 | GcuAccAcuccuucccuccdTsdT | sense |
| 1944-1963 | 4343 | GGAGGGAAGGAGUGGUAGC | 4344 | GGAGGGAAGGAGUGGuAGCdTsdT | antis |
| 2004-2023 | 4345 | CAUCUCUCGUCUUCCCUUC | 4346 | cAucucucGucuucccuucdTsdT | sense |
| 2004-2023 | 4347 | GAAGGGAAGACGAGAGAUG | 4348 | GAAGGGAAGACGAGAGAUGdTsdT | antis |
| 348-367 | 4349 | GUCGGGGCUAUGGGUGGGG | 4350 | GucGGGGcuAuGGGuGGGGdTsdT | sense |
| 348-367 | 4351 | CCCCACCCAUAGCCCCGAC | 4352 | CCCcACCcAuAGCCCCGACdTsdT | antis |
| 39-58 | 4353 | CCCGGCGUGCCCCGCGGCG | 4354 | cccGGcGuGccccGcGGcGdTsdT | sense |
| 39-58 | 4355 | CGCCGCGGGGCACGCCGGG | 4356 | CGCCGCGGGGcACGCCGGGdTsdT | antis |
| 184-203 | 4357 | UCGGCGCCAUGAGCGGCGG | 4358 | ucGGcGccAuGAGcGGcGGdTsdT | sense |
| 184-203 | 4359 | CCGCCGCUCAUGGCGCCGA | 4360 | CCGCCGCUcAUGGCGCCGAdTsdT | antis |
| 344-363 | 4361 | GUCAGUCGGGGCUAUGGGU | 4362 | GucAGucGGGGcuAuGGGudTsdT | sense |
| 344-363 | 4363 | ACCCAUAGCCCCGACUGAC | 4364 | ACCcAuAGCCCCGACUGACdTsdT | antis |
| 347-366 | 4365 | AGUCGGGGCUAUGGGUGGG | 4366 | AGucGGGGcuAuGGGuGGGdTsdT | sense |
| 347-366 | 4367 | CCCACCCAUAGCCCCGACU | 4368 | CCcACCcAuAGCCCCGACUdTsdT | antis |
| 454-473 | 4369 | CGCCGGGAGUGAAGCUGGG | 4370 | cGccGGGAGuGAAGcuGGGdTsdT | sense |
| 454-473 | 4371 | CCCAGCUUCACUCCCGGCG | 4372 | CCcAGCUUcACUCCCGGCGdTsdT | antis |
| 456-475 | 4373 | CCGGGAGUGAAGCUGGGCC | 4374 | ccGGGAGuGAAGcuGGGccdTsdT | sense |
| 456-475 | 4375 | GGCCCAGCUUCACUCCCGG | 4376 | GGCCcAGCUUcACUCCCGGdTsdT | antis |
| 477-496 | 4377 | GACAGCGGGAAGGUGACCA | 4378 | GAcAgcGGGAAGGuGAccAdTsdT | sense |
| 477-496 | 4379 | UGGUCACCUUCCCGCUGUC | 4380 | UGGUcACCUUCCCGCUGUCdTsdT | antis |
| 479-498 | 4381 | CAGCGGGAAGGUGACCACA | 4382 | cAgcGGGAAGGuGAccAcAdTsdT | sense |
| 479-498 | 4383 | UGUGGUCACCUUCCCGCUG | 4384 | UGUGGUcACCUUCCCGCUGdTsdT | antis |
| 517-536 | 4385 | AAGGCCCAGAGCGUUCCCA | 4386 | AAGGcccAGAGcGuucccAdTsdT | sense |
| 517-536 | 4387 | UGGGAACGCUCUGGGCCUU | 4388 | UGGGAACGCUCUGGGCCUUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 518-537 | 4389 | AGGCCCAGAGCGUUCCCAA | 4390 | AGGcccAGAGcGuucccAAdTsdT | sense |
| 518-537 | 4391 | UUGGGAACGCUCUGGGCCU | 4392 | UUGGGAACGCUCUGGGCCUdTsdT | antis |
| 519-538 | 4393 | GGCCCAGAGCGUUCCCAAG | 4394 | GGcccAGAGcGuucccAAGdTsdT | sense |
| 519-538 | 4395 | CUUGGGAACGCUCUGGGCC | 4396 | CUUGGGAACGCUCUGGGCCdTsdT | antis |
| 544-563 | 4397 | CUUACACUGACAUCAAAGU | 4398 | cuuAcAcuGAcAucAAAGudTsdT | sense |
| 544-563 | 4399 | ACUUUGAUGUCAGUGUAAG | 4400 | ACUUUGAUGUcAGUGuAAGdTsdT | antis |
| 545-564 | 4401 | UUACACUGACAUCAAAGUG | 4402 | uuAcAcuGAcAucAAAGuGdTsdT | sense |
| 545-564 | 4403 | CACUUUGAUGUCAGUGUAA | 4404 | cACUUUGAUGUcAGUGuAAdTsdT | antis |
| 603-622 | 4405 | CUGGCAGAGACGAGGGAAC | 4406 | cuGGcAGAGAcGAGGGAAcdTsdT | sense |
| 603-622 | 4407 | GUUCCCUCGUCUCUGCCAG | 4408 | GUUCCCUCGUCUCUGCcAGdTsdT | antis |
| 604-623 | 4409 | UGGCAGAGACGAGGGAACU | 4410 | uGGcAGAGAcGAGGGAAcudTsdT | sense |
| 604-623 | 4411 | AGUUCCCUCGUCUCUGCCA | 4412 | AGUUCCCUCGUCUCUGCcAdTsdT | antis |
| 741-760 | 4413 | GAGAAGAAGGACGAGCUGU | 4414 | GAGAAGAAGGAcGAGcuGudTsdT | sense |
| 741-760 | 4415 | ACAGCUCGUCCUUCUUCUC | 4416 | AcAGCUCGUCCUUCUUCUCdTsdT | antis |
| 752-771 | 4417 | CGAGCUGUAUUUGAAUCUG | 4418 | cGAGcuGuAuuuGAAucuGdTsdT | sense |
| 752-771 | 4419 | CAGAUUCAAAUACAGCUCG | 4420 | cAGAUUcAAAuAcAGCUCGdTsdT | antis |
| 753-772 | 4421 | GAGCUGUAUUUGAAUCUGG | 4422 | GAGcuGuAuuuGAAucuGGdTsdT | sense |
| 753-772 | 4423 | CCAGAUUCAAAUACAGCUC | 4424 | CcAGAUUcAAAuAcAGCUCdTsdT | antis |
| 831-850 | 4425 | CUGAUCACCCCUAUCAUCU | 4426 | cuGAucAccccuAucAucudTsdT | sense |
| 831-850 | 4427 | AGAUGAUAGGGGUGAUCAG | 4428 | AGAUGAuAGGGGUGAUcAGdTsdT | antis |
| 832-851 | 4429 | UGAUCACCCCUAUCAUCUA | 4430 | uGAucAccccuAucAucuAdTsdT | sense |
| 832-851 | 4431 | UAGAUGAUAGGGGUGAUCA | 4432 | uAGAUGAuAGGGGUGAUcAdTsdT | antis |
| 833-852 | 4433 | GAUCACCCCUAUCAUCUAC | 4434 | GAucAccccuAucAucuAcdTsdT | sense |
| 833-852 | 4435 | GUAGAUGAUAGGGGUGAUC | 4436 | GuAGAUGAuAGGGGUGAUCdTsdT | antis |
| 913-932 | 4437 | GUCACCGUGACAUCAAGCC | 4438 | GucAccGuGAcAucAAGccdTsdT | sense |
| 913-932 | 4439 | GGCUUGAUGUCACGGUGAC | 4440 | GGCUUGAUGUcACGGUGACdTsdT | antis |
| 918-937 | 4441 | CGUGACAUCAAGCCCCAGA | 4442 | cGuGAcAucAAGccccAGAdTsdT | sense |
| 918-937 | 4443 | UCUGGGGCUUGAUGUCACG | 4444 | UCUGGGGCUUGAUGUcACGdTsdT | antis |
| 920-939 | 4445 | UGACAUCAAGCCCCAGAAU | 4446 | uGAcAucAAGccccAGAAudTsdT | sense |
| 920-939 | 4447 | AUUCUGGGGCUUGAUGUCA | 4448 | AUUCUGGGGCUUGAUGUcAdTsdT | antis |
| 1018-1037 | 4449 | AUGUGUCCUACAUCUGCUC | 4450 | AuGuGuccuAcAucuGcucdTsdT | sense |
| 1018-1037 | 4451 | GAGCAGAUGUAGGACACAU | 4452 | GAGcAGAUGuAGGAcAcAUdTsdT | antis |
| 1019-1038 | 4453 | UGUGUCCUACAUCUGCUCU | 4454 | uGuGuccuAcAucuGcucudTsdT | sense |
| 1019-1038 | 4455 | AGAGCAGAUGUAGGACACA | 4456 | AGAGcAGAUGuAGGAcAcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1097-1116 | 4457 | UGUGUGGUCGGCUGGCUGU | 4458 | uGuGuGGucGGcuGGcuGudTsdT | sense |
| 1097-1116 | 4459 | ACAGCCAGCCGACCACACA | 4460 | AcAGCcAGCCGACcAcAcAdTsdT | antis |
| 1102-1121 | 4461 | GGUCGGCUGGCUGUGUACU | 4462 | GGucGGcuGGcuGuGuAcudTsdT | sense |
| 1102-1121 | 4463 | AGUACACAGCCAGCCGACC | 4464 | AGuAcAcAGCcAGCCGACCdTsdT | antis |
| 1155-1174 | 4465 | GGGGACAGUGGGGUGGACC | 4466 | GGGGAcAGuGGGGuGGAccdTsdT | sense |
| 1155-1174 | 4467 | GGUCCACCCCACUGUCCCC | 4468 | GGUCcACCCcACUGUCCCCdTsdT | antis |
| 1245-1264 | 4469 | ACGGAGUUCAAGUUCCCCC | 4470 | AcGGAGuucAAGuuccccdTsdT | sense |
| 1245-1264 | 4471 | GGGGGAACUUGAACUCCGU | 4472 | GGGGGAACUUGAACUCCGUdTsdT | antis |
| 1274-1293 | 4473 | UCACCCUUGGACAAAGGUG | 4474 | ucAcccuuGGAcAAAGGuGdTsdT | sense |
| 1274-1293 | 4475 | CACCUUUGUCCAAGGGUGA | 4476 | cACCUUUGUCcAAGGGUGAdTsdT | antis |
| 1276-1295 | 4477 | ACCCUUGGACAAAGGUGUU | 4478 | AcccuuGGAcAAAGGuGuudTsdT | sense |
| 1276-1295 | 4479 | AACACCUUUGUCCAAGGGU | 4480 | AAcACCUUUGUCcAAGGGUdTsdT | antis |
| 1316-1335 | 4481 | UGAGGCCAUUGCACUCUGC | 4482 | uGAGGccAuuGcAcucuGcdTsdT | sense |
| 1316-1335 | 4483 | GCAGAGUGCAAUGGCCUCA | 4484 | GcAGAGUGcAAUGGCCUcAdTsdT | antis |
| 1318-1337 | 4485 | AGGCCAUUGCACUCUGCUC | 4486 | AGGccAuuGcAcucuGcucdTsdT | sense |
| 1318-1337 | 4487 | GAGCAGAGUGCAAUGGCCU | 4488 | GAGcAGAGUGcAAUGGCCUdTsdT | antis |
| 1321-1340 | 4489 | CCAUUGCACUCUGCUCUAG | 4490 | ccAuuGcAcucuGcucuAGdTsdT | sense |
| 1321-1340 | 4491 | CUAGAGCAGAGUGCAAUGG | 4492 | CuAGAGcAGAGUGcAAUGGdTsdT | antis |
| 1325-1344 | 4493 | UGCACUCUGCUCUAGCCUA | 4494 | uGcAcucuGcucuAGccuAdTsdT | sense |
| 1325-1344 | 4495 | UAGGCUAGAGCAGAGUGCA | 4496 | uAGGCuAGAGcAGAGUGcAdTsdT | antis |
| 1337-1356 | 4497 | UAGCCUACUGGAGUACACG | 4498 | uAGccuAcuGGAGuAcAcGdTsdT | sense |
| 1337-1356 | 4499 | CGUGUACUCCAGUAGGCUA | 4500 | CGUGuACUCcAGuAGGCuAdTsdT | antis |
| 1375-1394 | 4501 | CACUCGAGGCUUGUGCCCA | 4502 | cAcucGAGGcuuGuGcccAdTsdT | sense |
| 1375-1394 | 4503 | UGGGCACAAGCCUCGAGUG | 4504 | UGGGcAcAAGCCUCGAGUGdTsdT | antis |
| 1443-1462 | 4505 | CGCCCGCUUCCCCCCCUGU | 4506 | cGcccGcuuccccccuGudTsdT | sense |
| 1443-1462 | 4507 | ACAGGGGGGAAGCGGGCG | 4508 | AcAGGGGGGAAGCGGGCGdTsdT | antis |
| 1466-1485 | 4509 | CUUCAGUCCUGGUGAACUG | 4510 | cuucAGuccuGGuGAAcuGdTsdT | sense |
| 1466-1485 | 4511 | CAGUUCACCAGGACUGAAG | 4512 | cAGUUcACcAGGACUGAAGdTsdT | antis |
| 1581-1600 | 4513 | UCACAAGCUUUAACUGAAG | 4514 | ucAcAAGcuuuAAcuGAAGdTsdT | sense |
| 1581-1600 | 4515 | CUUCAGUUAAAGCUUGUGA | 4516 | CUUcAGUuAAAGCUUGUGAdTsdT | antis |
| 1602-1621 | 4517 | CAGACUGGCCAAGAUUGGC | 4518 | cAGAcuGGccAAGAuuGGcdTsdT | sense |
| 1602-1621 | 4519 | GCCAAUCUUGGCCAGUCUG | 4520 | GCcAAUCUUGGCcAGUCUGdTsdT | antis |
| 1603-1622 | 4521 | AGACUGGCCAAGAUUGGCA | 4522 | AGAcuGGccAAGAuuGGcAdTsdT | sense |
| 1603-1622 | 4523 | UGCCAAUCUUGGCCAGUCU | 4524 | UGCcAAUCUUGGCcAGUCUdTsdT | antis |
| 1644-1663 | 4525 | ACCCUCGCUAGCUCUUCCU | 4526 | AcccucGcuAGcucuuccudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1644-1663 | 4527 | AGGAAGAGCUAGCGAGGGU | 4528 | AGGAAGAGCuAGCGAGGGUdTsdT | antis |
| 1666-1685 | 4529 | GGCCCCACCGACUACCCCU | 4530 | GGccccAccGAcuAccccudTsdT | sense |
| 1666-1685 | 4531 | AGGGGUAGUCGGUGGGGCC | 4532 | AGGGGuAGUCGGUGGGGCCdTsdT | antis |
| 1820-1839 | 4533 | CCUAACCUCUGUGGUGGGC | 4534 | ccuAAccucuGuGGuGGGcdTsdT | sense |
| 1820-1839 | 4535 | GCCCACCACAGAGGUUAGG | 4536 | GCCcAccAcAGAGGUuAGGdTsdT | antis |
| 1821-1840 | 4537 | CUAACCUCUGUGGUGGGCU | 4538 | cuAAccucuGuGGuGGGcudTsdT | sense |
| 1821-1840 | 4539 | AGCCCACCACAGAGGUUAG | 4540 | AGCCcAccAcAGAGGUuAGdTsdT | antis |
| 1855-1874 | 4541 | UAACUGUUUGUAGGGGAGG | 4542 | uAAcuGuuuGuAGGGGAGGdTsdT | sense |
| 1855-1874 | 4543 | CCUCCCCUACAAACAGUUA | 4544 | CCUCCCCuAcAAAcAGUuAdTsdT | antis |
| 1861-1880 | 4545 | UUUGUAGGGGAGGGGAGAA | 4546 | uuuGuAGGGGAGGGGAGAAdTsdT | sense |
| 1861-1880 | 4547 | UUCUCCCCUCCCCUACAAA | 4548 | UUCUCCCCUCCCCuAcAAAdTsdT | antis |
| 1912-1931 | 4549 | UUCUACCCCUUGGUCCCC | 4550 | uucuAccccuuGGuccccdTsdT | sense |
| 1912-1931 | 4551 | GGGGACCAAGGGGGUAGAA | 4552 | GGGGAccAAGGGGGuAGAAdTsdT | antis |
| 1960-1979 | 4553 | UCCCCCCCUCUCCCAGGUC | 4554 | ucccccccucucccAGGucdTsdT | sense |
| 1960-1979 | 4555 | GACCUGGGAGAGGGGGGGA | 4556 | GACCUGGGAGAGGGGGGGAdTsdT | antis |
| 2009-2028 | 4557 | CUCGUCUUCCCUUCCCUGG | 4558 | cucGucuucccuucccuGGdTsdT | sense |
| 2009-2028 | 4559 | CCAGGGAAGGGAAGACGAG | 4560 | CcAGGGAAGGGAAGACGAGdTsdT | antis |
| 2010-2029 | 4561 | UCGUCUUCCCUUCCCUGGC | 4562 | ucGucuucccuucccuGGcdTsdT | sense |
| 2010-2029 | 4563 | GCCAGGGAAGGGAAGACGA | 4564 | GCcAGGGAAGGGAAGACGAdTsdT | antis |
| 2011-2030 | 4565 | CGUCUUCCCUUCCCUGGCC | 4566 | cGucuucccuucccuGGccdTsdT | sense |
| 2011-2030 | 4567 | GGCCAGGGAAGGGAAGACG | 4568 | GGCcAGGGAAGGGAAGACGdTsdT | antis |
| 2223-2242 | 4569 | AGACCUCUGUUCAAUAAAU | 4570 | AGAccucuGuucAAuAAAudTsdT | sense |
| 2223-2242 | 4571 | AUUUAUUGAACAGAGGUCU | 4572 | AUUuAUUGAAcAGAGGUCUdTsdT | antis |
| 2226-2245 | 4573 | CCUCUGUUCAAUAAAUUAU | 4574 | ccucuGuucAAuAAAuuAudTsdT | sense |
| 2226-2245 | 4575 | AUAAUUUAUUGAACAGAGG | 4576 | AuAAUUuAUUGAAcAGAGGdTsdT | antis |
| 2228-2247 | 4577 | UCUGUUCAAUAAAUUAUUG | 4578 | ucuGuucAAuAAAuuAuuGdTsdT | sense |
| 2228-2247 | 4579 | CAAUAAUUUAUUGAACAGA | 4580 | cAAuAAUUuAUUGAAcAGAdTsdT | antis |
| 9-28 | 4581 | AACGAAGCCGACGGCAGAG | 4582 | AAcGAAGccGAcGGcAGAGdTsdT | sense |
| 9-28 | 4583 | CUCUGCCGUCGGCUUCGUU | 4584 | CUCUGCCGUCGGCUUCGUUdTsdT | antis |
| 10-29 | 4585 | ACGAAGCCGACGGCAGAGG | 4586 | AcGAAGccGAcGGcAGAGGdTsdT | sense |
| 10-29 | 4587 | CCUCUGCCGUCGGCUUCGU | 4588 | CCUCUGCCGUCGGCUUCGUdTsdT | antis |
| 20-39 | 4589 | CGGCAGAGGGACUUCAUCU | 4590 | cGGcAGAGGGAcuucAucudTsdT | sense |
| 20-39 | 4591 | AGAUGAAGUCCCUCUGCCG | 4592 | AGAUGAAGUCCCUCUGCCGdTsdT | antis |
| 26-45 | 4593 | AGGGACUUCAUCUCCCGGC | 4594 | AGGGAcuucAucucccGGcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 26-45 | 4595 | GCCGGGAGAUGAAGUCCCU | 4596 | GCCGGGAGAUGAAGUCCCUdTsdT | antis |
| 27-46 | 4597 | GGGACUUCAUCUCCCGGCG | 4598 | GGGAcuucAucuccCGGcGdTsdT | sense |
| 27-46 | 4599 | CGCCGGGAGAUGAAGUCCC | 4600 | CGCCGGGAGAUGAAGUCCCdTsdT | antis |
| 28-47 | 4601 | GGACUUCAUCUCCCGGCGU | 4602 | GGAcuucAucuccCGGcGudTsdT | sense |
| 28-47 | 4603 | ACGCCGGGAGAUGAAGUCC | 4604 | ACGCCGGGAGAUGAAGUCCdTsdT | antis |
| 29-48 | 4605 | GACUUCAUCUCCCGGCGUG | 4606 | GAcuucAucuccCGGcGuGdTsdT | sense |
| 29-48 | 4607 | CACGCCGGGAGAUGAAGUC | 4608 | cACGCCGGGAGAUGAAGUCdTsdT | antis |
| 37-56 | 4609 | CUCCCGGCGUGCCCCGCGG | 4610 | cucccGGcGuGccccGcGGdTsdT | sense |
| 37-56 | 4611 | CCGCGGGGCACGCCGGGAG | 4612 | CCGCGGGGcACGCCGGGAGdTsdT | antis |
| 38-57 | 4613 | UCCCGGCGUGCCCCGCGGC | 4614 | ucccGGcGuGccccGcGGcdTsdT | sense |
| 38-57 | 4615 | GCCGCGGGGCACGCCGGGA | 4616 | GCCGCGGGGcACGCCGGGAdTsdT | antis |
| 42-61 | 4617 | GGCGUGCCCCGCGGCGGGC | 4618 | GGcGuGccccGcGGcGGGcdTsdT | sense |
| 42-61 | 4619 | GCCCGCCGCGGGGCACGCC | 4620 | GCCCGCCGCGGGGcACGCCdTsdT | antis |
| 43-62 | 4621 | GCGUGCCCCGCGGCGGGCG | 4622 | GcGuGccccGcGGcGGGcGdTsdT | sense |
| 43-62 | 4623 | CGCCCGCCGCGGGGCACGC | 4624 | CGCCCGCCGCGGGGcACGCdTsdT | antis |
| 59-78 | 4625 | GCGCUGGGCCGGAGCCGGA | 4626 | GcGcuGGGccGGAGccGGAdTsdT | sense |
| 59-78 | 4627 | UCCGGCUCCGGCCCAGCGC | 4628 | UCCGGCUCCGGCCcAGCGCdTsdT | antis |
| 60-79 | 4629 | CGCUGGGCCGGAGCCGGAG | 4630 | cGcuGGGccGGAGccGGAGdTsdT | sense |
| 60-79 | 4631 | CUCCGGCUCCGGCCCAGCG | 4632 | CUCCGGCUCCGGCCcAGCGdTsdT | antis |
| 99-118 | 4633 | AGAGGCCGGAGCCCAGGGG | 4634 | AGAGGccGGAGcccAGGGGdTsdT | sense |
| 99-118 | 4635 | CCCCUGGGCUCCGGCCUCU | 4636 | CCCCUGGGCUCCGGCCUCUdTsdT | antis |
| 108-127 | 4637 | AGCCCAGGGGAGGCGGCGG | 4638 | AGcccAGGGGAGGcGGcGGdTsdT | sense |
| 108-127 | 4639 | CCGCCGCCUCCCCUGGGCU | 4640 | CCGCCGCCUCCCCUGGGCUdTsdT | antis |
| 109-128 | 4641 | GCCCAGGGGAGGCGGCGGC | 4642 | GcccAGGGGAGGcGGcGGcdTsdT | sense |
| 109-128 | 4643 | GCCGCCGCCUCCCCUGGGC | 4644 | GCCGCCGCCUCCCCUGGGCdTsdT | antis |
| 133-152 | 4645 | CAGCGGCGGGGGCAGCCCA | 4646 | cAGcGGcGGGGGcAGcccAdTsdT | sense |
| 133-152 | 4647 | UGGGCUGCCCCCGCCGCUG | 4648 | UGGGCUGCCCCCGCCGCUGdTsdT | antis |
| 135-154 | 4649 | GCGGCGGGGGCAGCCCAGG | 4650 | GcGGcGGGGGcAGcccAGGdTsdT | sense |
| 135-154 | 4651 | CCUGGGCUGCCCCCGCCGC | 4652 | CCUGGGCUGCCCCCGCCGCdTsdT | antis |
| 136-155 | 4653 | CGGCGGGGGCAGCCCAGGC | 4654 | cGGcGGGGGcAGcccAGGcdTsdT | sense |
| 136-155 | 4655 | GCCUGGGCUGCCCCCGCCG | 4656 | GCCUGGGCUGCCCCCGCCGdTsdT | antis |
| 140-159 | 4657 | GGGGGCAGCCCAGGCAGCC | 4658 | GGGGGcAGcccAGGcAGccdTsdT | sense |
| 140-159 | 4659 | GGCUGCCUGGGCUGCCCCC | 4660 | GGCUGCCUGGGCUGCCCCCdTsdT | antis |
| 165-184 | 4661 | CCGCGGCCUGGGCCUGCGC | 4662 | ccGcGGccuGGGccuGcGcdTsdT | sense |
| 165-184 | 4663 | GCGCAGGCCCAGGCCGCGG | 4664 | GCGcAGGCCcAGGCCGCGGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 170-189 | 4665 | GCCUGGGCCUGCGCUCGGC | 4666 | GccuGGGccuGcGcucGGcdTsdT | sense |
| 170-189 | 4667 | GCCGAGCGCAGGCCCAGGC | 4668 | GCCGAGCGcAGGCCcAGGCdTsdT | antis |
| 171-190 | 4669 | CCUGGGCCUGCGCUCGGCG | 4670 | ccuGGGccuGcGcucGGcGdTsdT | sense |
| 171-190 | 4671 | CGCCGAGCGCAGGCCCAGG | 4672 | CGCCGAGCGcAGGCCcAGGdTsdT | antis |
| 185-204 | 4673 | CGGCGCCAUGAGCGGCGGC | 4674 | cGGcGccAuGAGcGGcGGcdTsdT | sense |
| 185-204 | 4675 | GCCGCCGCUCAUGGCGCCG | 4676 | GCCGCCGCUcAUGGCGCCGdTsdT | antis |
| 201-220 | 4677 | GGCGGGCCUUCGGGAGGCG | 4678 | GGcGGGccuucGGGAGGcGdTsdT | sense |
| 201-220 | 4679 | CGCCUCCCGAAGGCCCGCC | 4680 | CGCCUCCCGAAGGCCCGCCdTsdT | antis |
| 214-233 | 4681 | GAGGCGGCCCUGGGGGCUC | 4682 | GAGGcGGcccuGGGGGcucdTsdT | sense |
| 214-233 | 4683 | GAGCCCCAGGGCCGCCUC | 4684 | GAGCCCCcAGGGCCGCCUCdTsdT | antis |
| 215-234 | 4685 | AGGCGGCCCUGGGGGCUCG | 4686 | AGGcGGcccuGGGGGcucGdTsdT | sense |
| 215-234 | 4687 | CGAGCCCCAGGGCCGCCU | 4688 | CGAGCCCCcAGGGCCGCCUdTsdT | antis |
| 216-235 | 4689 | GGCGGCCCUGGGGGCUCGG | 4690 | GGcGGcccuGGGGGcucGGdTsdT | sense |
| 216-235 | 4691 | CCGAGCCCCAGGGCCGCC | 4692 | CCGAGCCCCcAGGGCCGCCdTsdT | antis |
| 227-246 | 4693 | GGGCUCGGGCCGGGCGCGG | 4694 | GGGcucGGGccGGGcGcGGdTsdT | sense |
| 227-246 | 4695 | CCGCGCCCGGCCCGAGCCC | 4696 | CCGCGCCCGGCCCGAGCCCdTsdT | antis |
| 229-248 | 4697 | GCUCGGGCCGGGCGCGGAC | 4698 | GcucGGGccGGGcGcGGAcdTsdT | sense |
| 229-248 | 4699 | GUCCGCGCCCGGCCCGAGC | 4700 | GUCCGCGCCCGGCCCGAGCdTsdT | antis |
| 230-249 | 4701 | CUCGGGCCGGGCGCGGACC | 4702 | cucGGGccGGGcGcGGAccdTsdT | sense |
| 230-249 | 4703 | GGUCCGCGCCCGGCCCGAG | 4704 | GGUCCGCGCCCGGCCCGAGdTsdT | antis |
| 290-309 | 4705 | CGGCGGCCCCGGGGGCUCG | 4706 | cGGcGGccccGGGGGcucGdTsdT | sense |
| 290-309 | 4707 | CGAGCCCCGGGGCCGCCG | 4708 | CGAGCCCCGGGGCCGCCGdTsdT | antis |
| 292-311 | 4709 | GCGGCCCCGGGGGCUCGGC | 4710 | GcGGccccGGGGGcucGGcdTsdT | sense |
| 292-311 | 4711 | GCCGAGCCCCGGGGCCGC | 4712 | GCCGAGCCCCGGGGCCGCdTsdT | antis |
| 293-312 | 4713 | CGGCCCCGGGGGCUCGGCC | 4714 | cGGccccGGGGGcucGGccdTsdT | sense |
| 293-312 | 4715 | GGCCGAGCCCCGGGGCCG | 4716 | GGCCGAGCCCCGGGGCCGdTsdT | antis |
| 299-318 | 4717 | CGGGGGCUCGGCCUCUGGC | 4718 | cGGGGGcucGGccucuGGcdTsdT | sense |
| 299-318 | 4719 | GCCAGAGGCCGAGCCCCCG | 4720 | GCcAGAGGCCGAGCCCCCGdTsdT | antis |
| 300-319 | 4721 | GGGGGCUCGGCCUCUGGCC | 4722 | GGGGGcucGGccucuGGccdTsdT | sense |
| 300-319 | 4723 | GGCCAGAGGCCGAGCCCCC | 4724 | GGCcAGAGGCCGAGCCCCCdTsdT | antis |
| 302-321 | 4725 | GGGCUCGGCCUCUGGCCCA | 4726 | GGGcucGGccucuGGcccAdTsdT | sense |
| 302-321 | 4727 | UGGGCCAGAGGCCGAGCCC | 4728 | UGGGCcAGAGGCCGAGCCCdTsdT | antis |
| 304-323 | 4729 | GCUCGGCCUCUGGCCCAGG | 4730 | GcucGGccucuGGcccAGGdTsdT | sense |
| 304-323 | 4731 | CCUGGGCCAGAGGCCGAGC | 4732 | CCUGGGCcAGAGGCCGAGCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 305-324 | 4733 | CUCGGCCUCUGGCCCAGGA | 4734 | cucGGccucuGGcccAGGAdTsdT | sense |
| 305-324 | 4735 | UCCUGGGCCAGAGGCCGAG | 4736 | UCCUGGGCcAGAGGCCGAGdTsdT | antis |
| 306-325 | 4737 | UCGGCCUCUGGCCCAGGAG | 4738 | ucGGccucuGGcccAGGAGdTsdT | sense |
| 306-325 | 4739 | CUCCUGGGCCAGAGGCCGA | 4740 | CUCCUGGGCcAGAGGCCGAdTsdT | antis |
| 307-326 | 4741 | CGGCCUCUGGCCCAGGAGG | 4742 | cGGccucuGGcccAGGAGGdTsdT | sense |
| 307-326 | 4743 | CCUCCUGGGCCAGAGGCCG | 4744 | CCUCCUGGGCcAGAGGCCGdTsdT | antis |
| 322-341 | 4745 | GAGGCACUGGCGGCGGGAA | 4746 | GAGGcAcuGGcGGcGGGAAdTsdT | sense |
| 322-341 | 4747 | UUCCCGCCGCCAGUGCCUC | 4748 | UUCCCGCCGCcAGUGCCUCdTsdT | antis |
| 339-358 | 4749 | AAAGCGUCAGUCGGGGCUA | 4750 | AAAGcGucAGucGGGGcuAdTsdT | sense |
| 339-358 | 4751 | UAGCCCCGACUGACGCUUU | 4752 | uAGCCCCGACUGACGCUUUdTsdT | antis |
| 345-364 | 4753 | UCAGUCGGGGCUAUGGGUG | 4754 | ucAGucGGGGcuAuGGGuGdTsdT | sense |
| 345-364 | 4755 | CACCCAUAGCCCCGACUGA | 4756 | cACCcAuAGCCCCGACUGAdTsdT | antis |
| 346-365 | 4757 | CAGUCGGGGCUAUGGGUGG | 4758 | cAGucGGGGcuAuGGGuGGdTsdT | sense |
| 346-365 | 4759 | CCACCCAUAGCCCCGACUG | 4760 | CcACCcAuAGCCCCGACUGdTsdT | antis |
| 350-369 | 4761 | CGGGGCUAUGGGUGGGGGC | 4762 | cGGGGcuAuGGGuGGGGGcdTsdT | sense |
| 350-369 | 4763 | GCCCCCACCCAUAGCCCCG | 4764 | GCCCCcACCcAuAGCCCCGdTsdT | antis |
| 374-393 | 4765 | AGCCUCGAGCUCCGGGGGU | 4766 | AGccucGAGcuccGGGGGudTsdT | sense |
| 374-393 | 4767 | ACCCCCGGAGCUCGAGGCU | 4768 | ACCCCCGGAGCUCGAGGCUdTsdT | antis |
| 378-397 | 4769 | UCGAGCUCCGGGGGUGGCC | 4770 | ucGAGcuccGGGGGuGGccdTsdT | sense |
| 378-397 | 4771 | GGCCACCCCCGGAGCUCGA | 4772 | GGCcACCCCCGGAGCUCGAdTsdT | antis |
| 379-398 | 4773 | CGAGCUCCGGGGGUGGCCC | 4774 | cGAGcuccGGGGGuGGcccdTsdT | sense |
| 379-398 | 4775 | GGGCCACCCCCGGAGCUCG | 4776 | GGGCcACCCCCGGAGCUCGdTsdT | antis |
| 384-403 | 4777 | UCCGGGGGUGGCCCCAGCG | 4778 | uccGGGGGuGGccccAGcGdTsdT | sense |
| 384-403 | 4779 | CGCUGGGGCCACCCCCGGA | 4780 | CGCUGGGGCcACCCCCGGAdTsdT | antis |
| 394-413 | 4781 | GCCCCAGCGGCAGCGGCGG | 4782 | GccccAGcGGcAGcGGcGGdTsdT | sense |
| 394-413 | 4783 | CCGCCGCUGCCGCUGGGGC | 4784 | CCGCCGCUGCCGCUGGGGCdTsdT | antis |
| 418-437 | 4785 | GCAGCGGUGGCCCCGGCGC | 4786 | GcAGcGGuGGccccGGcGcdTsdT | sense |
| 418-437 | 4787 | GCGCCGGGGCCACCGCUGC | 4788 | GCGCCGGGGCcACCGCUGCdTsdT | antis |
| 419-438 | 4789 | CAGCGGUGGCCCCGGCGCG | 4790 | cAGcGGuGGccccGGcGcGdTsdT | sense |
| 419-438 | 4791 | CGCGCCGGGGCCACCGCUG | 4792 | CGCGCCGGGGCcACCGCUGdTsdT | antis |
| 421-440 | 4793 | GCGGUGGCCCCGGCGCGGG | 4794 | GcGGuGGccccGGcGcGGGdTsdT | sense |
| 421-440 | 4795 | CCCGCGCCGGGGCCACCGC | 4796 | CCCGCGCCGGGGCcACCGCdTsdT | antis |
| 422-441 | 4797 | CGGUGGCCCCGGCGCGGGC | 4798 | cGGuGGccccGGcGcGGGcdTsdT | sense |
| 422-441 | 4799 | GCCCGCGCCGGGGCCACCG | 4800 | GCCCGCGCCGGGGCcACCGdTsdT | antis |
| 423-442 | 4801 | GGUGGCCCCGGCGCGGGCA | 4802 | GGuGGccccGGcGcGGGcAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 423-442 | 4803 | UGCCCGCGCCGGGGCCACC | 4804 | UGCCCGCGCCGGGGCcACCdTsdT | antis |
| 424-443 | 4805 | GUGGCCCCGGCGCGGGCAC | 4806 | GuGGccccGGcGcGGGcAcdTsdT | sense |
| 424-443 | 4807 | GUGCCCGCGCCGGGGCCAC | 4808 | GUGCCCGCGCCGGGGCcACdTsdT | antis |
| 443-462 | 4809 | UAGCUUCCCGCCGCCGGGA | 4810 | uAGcuucccGccGccGGGAdTsdT | sense |
| 443-462 | 4811 | UCCCGGCGGCGGGAAGCUA | 4812 | UCCCGGCGGCGGGAAGCuAdTsdT | antis |
| 450-469 | 4813 | CCGCCGCCGGGAGUGAAGC | 4814 | ccGccGccGGGAGuGAAGcdTsdT | sense |
| 450-469 | 4815 | GCUUCACUCCCGGCGGCGG | 4816 | GCUUcACUCCCGGCGGCGGdTsdT | antis |
| 455-474 | 4817 | GCCGGGAGUGAAGCUGGGC | 4818 | GccGGGAGuGAAGcuGGGcdTsdT | sense |
| 455-474 | 4819 | GCCCAGCUUCACUCCCGGC | 4820 | GCCcAGCUUcACUCCCGGCdTsdT | antis |
| 457-476 | 4821 | CGGGAGUGAAGCUGGGCCG | 4822 | cGGGAGuGAAGcuGGGccGdTsdT | sense |
| 457-476 | 4823 | CGGCCCAGCUUCACUCCCG | 4824 | CGGCCcAGCUUcACUCCCGdTsdT | antis |
| 462-481 | 4825 | GUGAAGCUGGGCCGUGACA | 4826 | GuGAAGcuGGGccGuGAcAdTsdT | sense |
| 462-481 | 4827 | UGUCACGGCCCAGCUUCAC | 4828 | UGUcACGGCCcAGCUUcACdTsdT | antis |
| 467-486 | 4829 | GCUGGGCCGUGACAGCGGG | 4830 | GcuGGGccGuGAcAGcGGGdTsdT | sense |
| 467-486 | 4831 | CCCGCUGUCACGGCCCAGC | 4832 | CCCGCUGUcACGGCCcAGCdTsdT | antis |
| 478-497 | 4833 | ACAGCGGGAAGGUGACCAC | 4834 | AcAGcGGGAAGGuGAccAcdTsdT | sense |
| 478-497 | 4835 | GUGGUCACCUUCCCGCUGU | 4836 | GUGGUcACCUUCCCGCUGUdTsdT | antis |
| 482-501 | 4837 | CGGGAAGGUGACCACAGUG | 4838 | cGGGAAGGuGAccAcAGuGdTsdT | sense |
| 482-501 | 4839 | CACUGUGGUCACCUUCCCG | 4840 | cACUGUGGUcACCUUCCCGdTsdT | antis |
| 498-517 | 4841 | GUGGUAGCCACUGUAGGCC | 4842 | GuGGUAGccAcuGuAGGccdTsdT | sense |
| 498-517 | 4843 | GGCCUACAGUGGCUACCAC | 4844 | GGCCuAcAGUGGCuAccACdTsdT | antis |
| 499-518 | 4845 | UGGUAGCCACUGUAGGCCA | 4846 | uGGuAGccAcuGuAGGccAdTsdT | sense |
| 499-518 | 4847 | UGGCCUACAGUGGCUACCA | 4848 | UGGCCuAcAGUGGCuAccAdTsdT | antis |
| 500-519 | 4849 | GGUAGCCACUGUAGGCCAA | 4850 | GGuAGccAcuGuAGGccAAdTsdT | sense |
| 500-519 | 4851 | UUGGCCUACAGUGGCUACC | 4852 | UUGGCCuAcAGUGGCuACCdTsdT | antis |
| 501-520 | 4853 | GUAGCCACUGUAGGCCAAG | 4854 | GuAGccAcuGuAGGccAAGdTsdT | sense |
| 501-520 | 4855 | CUUGGCCUACAGUGGCUAC | 4856 | CUUGGCCuAcAGUGGCuACdTsdT | antis |
| 508-527 | 4857 | CUGUAGGCCAAGGCCCAGA | 4858 | cuGuAGGccAAGGcccAGAdTsdT | sense |
| 508-527 | 4859 | UCUGGGCCUUGGCCUACAG | 4860 | UCUGGGCCUUGGCCuAcAGdTsdT | antis |
| 514-533 | 4861 | GCCAAGGCCCAGAGCGUUC | 4862 | GccAAGGcccAGAGcGuucdTsdT | sense |
| 514-533 | 4863 | GAACGCUCUGGGCCUUGGC | 4864 | GAACGCUCUGGGCCUUGGCdTsdT | antis |
| 515-534 | 4865 | CCAAGGCCCAGAGCGUUCC | 4866 | ccAAGGcccAGAGcGuuccdTsdT | sense |
| 515-534 | 4867 | GGAACGCUCUGGGCCUUGG | 4868 | GGAACGCUCUGGGCCUUGGdTsdT | antis |
| 540-559 | 4869 | GUGGCUUACACUGACAUCA | 4870 | GuGGcuuAcAcuGAcAucAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 540-559 | 4871 | UGAUGUCAGUGUAAGCCAC | 4872 | UGAUGUcAGUGUaAGCcACdTsdT | antis |
| 541-560 | 4873 | UGGCUUACACUGACAUCAA | 4874 | uGGcuuAcAcuGAcAucAAdTsdT | sense |
| 541-560 | 4875 | UUGAUGUCAGUGUAAGCCA | 4876 | UUGAUGUcAGUGUaAGCcAdTsdT | antis |
| 543-562 | 4877 | GCUUACACUGACAUCAAAG | 4878 | GcuuAcAcuGAcAucAAAGdTsdT | sense |
| 543-562 | 4879 | CUUUGAUGUCAGUGUAAGC | 4880 | CUUUGAUGUcAGUGUaAGCdTsdT | antis |
| 546-565 | 4881 | UACACUGACAUCAAAGUGA | 4882 | uAcAcuGAcAucAAAGuGAdTsdT | sense |
| 546-565 | 4883 | UCACUUUGAUGUCAGUGUA | 4884 | UcACUUUGAUGUcAGUGUAdTsdT | antis |
| 594-613 | 4885 | CAGGCACGGCUGGCAGAGA | 4886 | cAGGcAcGGcuGGcAGAGAdTsdT | sense |
| 594-613 | 4887 | UCUCUGCCAGCCGUGCCUG | 4888 | UCUCUGCcAGCCGUGCCUGdTsdT | antis |
| 605-624 | 4889 | GGCAGAGACGAGGGAACUG | 4890 | GGcAGAGAcGAGGGAAcuGdTsdT | sense |
| 605-624 | 4891 | CAGUUCCCUCGUCUCUGCC | 4892 | cAGUUCCCUCGUCUCUGCCdTsdT | antis |
| 607-626 | 4893 | CAGAGACGAGGGAACUGGU | 4894 | cAGAGAcGAGGGAAcuGGudTsdT | sense |
| 607-626 | 4895 | ACCAGUUCCCUCGUCUCUG | 4896 | ACcAGUUCCCUCGUCUCUGdTsdT | antis |
| 617-636 | 4897 | GGAACUGGUGGCCAUCAAG | 4898 | GGAAcuGGuGGccAucAAGdTsdT | sense |
| 617-636 | 4899 | CUUGAUGGCCACCAGUUCC | 4900 | CUUGAUGGCcAccAGUUCCdTsdT | antis |
| 618-637 | 4901 | GAACUGGUGGCCAUCAAGA | 4902 | GAAcuGGuGGccAucAAGAdTsdT | sense |
| 618-637 | 4903 | UCUUGAUGGCCACCAGUUC | 4904 | UCUUGAUGGCcAccAGUUCdTsdT | antis |
| 619-638 | 4905 | AACUGGUGGCCAUCAAGAA | 4906 | AAcuGGuGGccAucAAGAAdTsdT | sense |
| 619-638 | 4907 | UUCUUGAUGGCCACCAGUU | 4908 | UUCUUGAUGGCcAccAGUUdTsdT | antis |
| 624-643 | 4909 | GUGGCCAUCAAGAAGGUUC | 4910 | GuGGccAucAAGAAGGuucdTsdT | sense |
| 624-643 | 4911 | GAACCUUCUUGAUGGCCAC | 4912 | GAACCUUCUUGAUGGCcACdTsdT | antis |
| 625-644 | 4913 | UGGCCAUCAAGAAGGUUCU | 4914 | uGGccAucAAGAAGGuucudTsdT | sense |
| 625-644 | 4915 | AGAACCUUCUUGAUGGCCA | 4916 | AGAACCUUCUUGAUGGCcAdTsdT | antis |
| 647-666 | 4917 | GGACAAAAGGUUCAAGAAC | 4918 | GGAcAAAAGGuucAAGAAcdTsdT | sense |
| 647-666 | 4919 | GUUCUUGAACCUUUUGUCC | 4920 | GUUCUUGAACCUUUUGUCCdTsdT | antis |
| 648-667 | 4921 | GACAAAAGGUUCAAGAACC | 4922 | GAcAAAAGGuucAAGAAccdTsdT | sense |
| 648-667 | 4923 | GGUUCUUGAACCUUUUGUC | 4924 | GGUUCUUGAACCUUUUGUCdTsdT | antis |
| 666-685 | 4925 | CGAGAACUGCAGAUUAUGC | 4926 | cGAGAAcuGcAGAuuAuGcdTsdT | sense |
| 666-685 | 4927 | GCAUAAUCUGCAGUUCUCG | 4928 | GcAuAAUCUGcAGUUCUCGdTsdT | antis |
| 713-732 | 4929 | GCUGCGGUACUUUUUCUAC | 4930 | GcuGcGGuAcuuuuucuAcdTsdT | sense |
| 713-732 | 4931 | GUAGAAAAAGUACCGCAGC | 4932 | GuAGAAAAAGuACCGcAGCdTsdT | antis |
| 717-736 | 4933 | CGGUACUUUUUCUACUCCA | 4934 | cGGuAcuuuuucuAcuccAdTsdT | sense |
| 717-736 | 4935 | UGGAGUAGAAAAAGUACCG | 4936 | UGGAGuAGAAAAAGuACCGdTsdT | antis |
| 739-758 | 4937 | GGGAGAAGAAGGACGAGCU | 4938 | GGGAGAAGAAGGAcGAGcudTsdT | sense |
| 739-758 | 4939 | AGCUCGUCCUUCUUCUCCC | 4940 | AGCUCGUCCUUCUUCUCCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 740-759 | 4941 | GGAGAAGAAGGACGAGCUG | 4942 | GGAGAAGAAGGAcGAGcuGdTsdT | sense |
| 740-759 | 4943 | CAGCUCGUCCUUCUUCUCC | 4944 | cAGCUCGUCCUUCUUCUCCdTsdT | antis |
| 794-813 | 4945 | GGUGUACCGAGUGGCCCGC | 4946 | GGuGuAccGAGuGGcccGcdTsdT | sense |
| 794-813 | 4947 | GCGGGCCACUCGGUACACC | 4948 | GCGGGCcACUCGGuAcACCdTsdT | antis |
| 798-817 | 4949 | UACCGAGUGGCCCGCCACU | 4950 | uAccGAGuGGcccGccAcudTsdT | sense |
| 798-817 | 4951 | AGUGGCGGGCCACUCGGUA | 4952 | AGUGGCGGGCcACUCGGuAdTsdT | antis |
| 822-841 | 4953 | AAGGCCAAGCUGAUCACCC | 4954 | AAGGccAAGcuGAucAcccdTsdT | sense |
| 822-841 | 4955 | GGGUGAUCAGCUUGGCCUU | 4956 | GGGUGAUcAGCUUGGCCUUdTsdT | antis |
| 823-842 | 4957 | AGGCCAAGCUGAUCACCCC | 4958 | AGGccAAGcuGAucAccccdTsdT | sense |
| 823-842 | 4959 | GGGGUGAUCAGCUUGGCCU | 4960 | GGGGUGAUcAGCUUGGCCUdTsdT | antis |
| 846-865 | 4961 | AUCUACAUCAAGGUGUACA | 4962 | AucuAcAucAAGGuGuAcAdTsdT | sense |
| 846-865 | 4963 | UGUACACCUUGAUGUAGAU | 4964 | UGuAcACCUUGAUGuAGAUdTsdT | antis |
| 847-866 | 4965 | UCUACAUCAAGGUGUACAU | 4966 | ucuAcAucAAGGuGuAcAudTsdT | sense |
| 847-866 | 4967 | AUGUACACCUUGAUGUAGA | 4968 | AUGuAcACCUUGAUGuAGAdTsdT | antis |
| 848-867 | 4969 | CUACAUCAAGGUGUACAUG | 4970 | cuAcAucAAGGuGuAcAuGdTsdT | sense |
| 848-867 | 4971 | CAUGUACACCUUGAUGUAG | 4972 | cAUGuAcACCUUGAUGuAGdTsdT | antis |
| 849-868 | 4973 | UACAUCAAGGUGUACAUGU | 4974 | uAcAucAAGGuGuAcAuGudTsdT | sense |
| 849-868 | 4975 | ACAUGUACACCUUGAUGUA | 4976 | AcAUGuAcACCUUGAUGuAdTsdT | antis |
| 889-908 | 4977 | CCUACAUCCACUCCCAAGG | 4978 | ccuAcAuccAcucccAAGGdTsdT | sense |
| 889-908 | 4979 | CCUUGGGAGUGGAUGUAGG | 4980 | CCUUGGGAGUGGAUGuAGGdTsdT | antis |
| 892-911 | 4981 | ACAUCCACUCCCAAGGUGU | 4982 | AcAuccAcucccAAGGuGudTsdT | sense |
| 892-911 | 4983 | ACACCUUGGGAGUGGAUGU | 4984 | AcACCUUGGGAGUGGAUGUdTsdT | antis |
| 893-912 | 4985 | CAUCCACUCCCAAGGUGUG | 4986 | cAuccAcucccAAGGuGuGdTsdT | sense |
| 893-912 | 4987 | CACACCUUGGGAGUGGAUG | 4988 | cAcACCUUGGGAGUGGAUGdTsdT | antis |
| 904-923 | 4989 | AAGGUGUGUGUCACCGUGA | 4990 | AAGGuGuGuGucAccGuGAdTsdT | sense |
| 904-923 | 4991 | UCACGGUGACACACACCUU | 4992 | UcACGGUGAcAcAcACCUUdTsdT | antis |
| 905-924 | 4993 | AGGUGUGUGUCACCGUGAC | 4994 | AGGuGuGuGucAccGuGAcdTsdT | sense |
| 905-924 | 4995 | GUCACGGUGACACACACCU | 4996 | GUcACGGUGAcAcAcACCUdTsdT | antis |
| 906-925 | 4997 | GGUGUGUGUCACCGUGACA | 4998 | GGuGuGuGucAccGuGAcAdTsdT | sense |
| 906-925 | 4999 | UGUCACGGUGACACACACC | 5000 | UGUcACGGUGAcAcAcACCdTsdT | antis |
| 907-926 | 5001 | GUGUGUGUCACCGUGACAU | 5002 | GuGuGuGucAccGuGAcAudTsdT | sense |
| 907-926 | 5003 | AUGUCACGGUGACACACAC | 5004 | AUGUcACGGUGAcAcAcACdTsdT | antis |
| 908-927 | 5005 | UGUGUGUCACCGUGACAUC | 5006 | uGuGuGucAccGuGAcAucdTsdT | sense |
| 908-927 | 5007 | GAUGUCACGGUGACACACA | 5008 | GAUGUcACGGUGAcAcAcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 909-928 | 5009 | GUGUGUCACCGUGACAUCA | 5010 | GuGuGucAccGuGAcAucAdTsdT | sense |
| 909-928 | 5011 | UGAUGUCACGGUGACACAC | 5012 | UGAUGUcACGGUGAcAcACdTsdT | antis |
| 910-929 | 5013 | UGUGUCACCGUGACAUCAA | 5014 | uGuGucAccGuGAcAucAAdTsdT | sense |
| 910-929 | 5015 | UUGAUGUCACGGUGACACA | 5016 | UUGAUGUcACGGUGAcAcAdTsdT | antis |
| 919-938 | 5017 | GUGACAUCAAGCCCCAGAA | 5018 | GuGAcAucAAGccccAGAAdTsdT | sense |
| 919-938 | 5019 | UUCUGGGGCUUGAUGUCAC | 5020 | UUCUGGGGCUUGAUGUcACdTsdT | antis |
| 946-965 | 5021 | UGGACCCUGACACUGCUGU | 5022 | uGGAcccuGAcAcuGcuGudTsdT | sense |
| 946-965 | 5023 | ACAGCAGUGUCAGGGUCCA | 5024 | AcAGcAGUGUcAGGGUCcAdTsdT | antis |
| 950-969 | 5025 | CCCUGACACUGCUGUCCUC | 5026 | cccuGAcAcuGcuGuccucdTsdT | sense |
| 950-969 | 5027 | GAGGACAGCAGUGUCAGGG | 5028 | GAGGAcAGcAGUGUcAGGGdTsdT | antis |
| 957-976 | 5029 | ACUGCUGUCCUCAAGCUCU | 5030 | AcuGcuGuccucAAGcucudTsdT | sense |
| 957-976 | 5031 | AGAGCUUGAGGACAGCAGU | 5032 | AGAGCUUGAGGAcAGcAGUdTsdT | antis |
| 961-980 | 5033 | CUGUCCUCAAGCUCUGCGA | 5034 | cuGuccucAAGcucuGcGAdTsdT | sense |
| 961-980 | 5035 | UCGCAGAGCUUGAGGACAG | 5036 | UCGcAGAGCUUGAGGAcAGdTsdT | antis |
| 962-981 | 5037 | UGUCCUCAAGCUCUGCGAU | 5038 | uGuccucAAGcucuGcGAudTsdT | sense |
| 962-981 | 5039 | AUCGCAGAGCUUGAGGACA | 5040 | AUCGcAGAGCUUGAGGAcAdTsdT | antis |
| 1020-1039 | 5041 | GUGUCCUACAUCUGCUCUC | 5042 | GuGuccuAcAucuGcucucdTsdT | sense |
| 1020-1039 | 5043 | GAGAGCAGAUGUAGGACAC | 5044 | GAGAGcAGAUGuAGGAcACdTsdT | antis |
| 1029-1048 | 5045 | AUCUGCUCUCGGUACUACC | 5046 | AucuGcucucGGuAcuAccdTsdT | sense |
| 1029-1048 | 5047 | GGUAGUACCGAGAGCAGAU | 5048 | GGuAGuACCGAGAGcAGAUdTsdT | antis |
| 1048-1067 | 5049 | GUGCUCCAGAACUCAUCUU | 5050 | GuGcuccAGAAcucAucuudTsdT | sense |
| 1048-1067 | 5051 | AAGAUGAGUUCUGGAGCAC | 5052 | AAGAUGAGUUCUGGAGcACdTsdT | antis |
| 1049-1068 | 5053 | UGCUCCAGAACUCAUCUUU | 5054 | uGcuccAGAAcucAucuuudTsdT | sense |
| 1049-1068 | 5055 | AAAGAUGAGUUCUGGAGCA | 5056 | AAAGAUGAGUUCUGGAGcAdTsdT | antis |
| 1050-1069 | 5057 | GCUCCAGAACUCAUCUUUG | 5058 | GcuccAGAAcucAucuuuGdTsdT | sense |
| 1050-1069 | 5059 | CAAAGAUGAGUUCUGGAGC | 5060 | cAAAGAUGAGUUCUGGAGCdTsdT | antis |
| 1059-1078 | 5061 | CUCAUCUUUGGAGCCACAG | 5062 | cucAucuuuGGAGccAcAGdTsdT | sense |
| 1059-1078 | 5063 | CUGUGGCUCCAAAGAUGAG | 5064 | CUGUGGCUCcAAAGAUGAGdTsdT | antis |
| 1087-1106 | 5065 | CGUCCAUCGAUGUGUGGUC | 5066 | cGuccAucGAuGuGuGGucdTsdT | sense |
| 1087-1106 | 5067 | GACCACACAUCGAUGGACG | 5068 | GACcAcAcAUCGAUGGACGdTsdT | antis |
| 1096-1115 | 5069 | AUGUGUGGUCGGCUGGCUG | 5070 | AuGuGuGGucGGcuGGcuGdTsdT | sense |
| 1096-1115 | 5071 | CAGCCAGCCGACCACACAU | 5072 | cAGCcAGCCGACcAcAcAUdTsdT | antis |
| 1130-1149 | 5073 | ACUUCUCGGCCAGCCCAUC | 5074 | AcuucucGGccAGcccAucdTsdT | sense |
| 1130-1149 | 5075 | GAUGGGCUGGCCGAGAAGU | 5076 | GAUGGGCUGGCCGAGAAGUdTsdT | antis |
| 1134-1153 | 5077 | CUCGGCCAGCCCAUCUUCC | 5078 | cucGGccAGcccAucuuccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1134-1153 | 5079 | GGAAGAUGGGCUGGCCGAG | 5080 | GGAAGAUGGGCUGGCCGAGdTsdT | antis |
| 1141-1160 | 5081 | AGCCCAUCUUCCCUGGGGA | 5082 | AGcccAucuucccuGGGGAdTsdT | sense |
| 1141-1160 | 5083 | UCCCCAGGGAAGAUGGGCU | 5084 | UCCCcAGGGAAGAUGGGCUdTsdT | antis |
| 1144-1163 | 5085 | CCAUCUUCCCUGGGGACAG | 5086 | ccAucuucccuGGGGAcAGdTsdT | sense |
| 1144-1163 | 5087 | CUGUCCCCAGGGAAGAUGG | 5088 | CUGUCCCcAGGGAAGAUGGdTsdT | antis |
| 1151-1170 | 5089 | CCCUGGGGACAGUGGGGUG | 5090 | cccuGGGGAcAGuGGGGuGdTsdT | sense |
| 1151-1170 | 5091 | CACCCCACUGUCCCCAGGG | 5092 | cACCCcACUGUCCCcAGGGdTsdT | antis |
| 1156-1175 | 5093 | GGGACAGUGGGGUGGACCA | 5094 | GGGAcAGuGGGGuGGAccAdTsdT | sense |
| 1156-1175 | 5095 | UGGUCCACCCCACUGUCCC | 5096 | UGGUCcACCCcACUGUCCCdTsdT | antis |
| 1157-1176 | 5097 | GGACAGUGGGGUGGACCAG | 5098 | GGAcAGuGGGGuGGAccAGdTsdT | sense |
| 1157-1176 | 5099 | CUGGUCCACCCCACUGUCC | 5100 | CUGGUCcACCCcACUGUCCdTsdT | antis |
| 1158-1177 | 5101 | GACAGUGGGGUGGACCAGC | 5102 | GAcAGuGGGGuGGAccAGcdTsdT | sense |
| 1158-1177 | 5103 | GCUGGUCCACCCCACUGUC | 5104 | GCUGGUCcACCCcACUGUCdTsdT | antis |
| 1159-1178 | 5105 | ACAGUGGGGUGGACCAGCU | 5106 | AcAGuGGGGuGGAccAGcudTsdT | sense |
| 1159-1178 | 5107 | AGCUGGUCCACCCCACUGU | 5108 | AGCUGGUCcACCCcACUGUdTsdT | antis |
| 1160-1179 | 5109 | CAGUGGGGUGGACCAGCUU | 5110 | cAGuGGGGuGGAccAGcuudTsdT | sense |
| 1160-1179 | 5111 | AAGCUGGUCCACCCCACUG | 5112 | AAGCUGGUCcACCCcACUGdTsdT | antis |
| 1244-1263 | 5113 | UACGGAGUUCAAGUUCCCC | 5114 | uAcGGAGuucAAGuuccccdTsdT | sense |
| 1244-1263 | 5115 | GGGGAACUUGAACUCCGUA | 5116 | GGGGAACUUGAACUCCGuAdTsdT | antis |
| 1246-1265 | 5117 | CGGAGUUCAAGUUCCCCA | 5118 | cGGAGuucAAGuuccccAdTsdT | sense |
| 1246-1265 | 5119 | UGGGGGAACUUGAACUCCG | 5120 | UGGGGGAACUUGAACUCCGdTsdT | antis |
| 1273-1292 | 5121 | CUCACCCUUGGACAAAGGU | 5122 | cucAcccuuGGAcAAAGGudTsdT | sense |
| 1273-1292 | 5123 | ACCUUUGUCCAAGGGUGAG | 5124 | ACCUUUGUCcAAGGGUGAGdTsdT | antis |
| 1275-1294 | 5125 | CACCCUUGGACAAAGGUGU | 5126 | cAcccuuGGAcAAAGGuGudTsdT | sense |
| 1275-1294 | 5127 | ACACCUUUGUCCAAGGGUG | 5128 | AcACCUUUGUCcAAGGGUGdTsdT | antis |
| 1278-1297 | 5129 | CCUUGGACAAAGGUGUUCA | 5130 | ccuuGGAcAAAGGuGuucAdTsdT | sense |
| 1278-1297 | 5131 | UGAACACCUUUGUCCAAGG | 5132 | UGAAcACCUUUGUCcAAGGdTsdT | antis |
| 1279-1298 | 5133 | CUUGGACAAAGGUGUUCAA | 5134 | cuuGGAcAAAGGuGuucAAdTsdT | sense |
| 1279-1298 | 5135 | UUGAACACCUUUGUCCAAG | 5136 | UUGAAcACCUUUGUCcAAGdTsdT | antis |
| 1288-1307 | 5137 | AGGUGUUCAAAUCUUCAAA | 5138 | AGGuGuucAAAucuucAAAdTsdT | sense |
| 1288-1307 | 5139 | UUUGAAGAUUUGAACACCU | 5140 | UUUGAAGAUUUGAAcACCUdTsdT | antis |
| 1291-1310 | 5141 | UGUUCAAAUCUUCAAAGAC | 5142 | uGuucAAAucuucAAAGAcdTsdT | sense |
| 1291-1310 | 5143 | GUCUUUGAAGAUUUGAACA | 5144 | GUCUUUGAAGAUUUGAAcAdTsdT | antis |
| 1292-1311 | 5145 | GUUCAAAUCUUCAAAGACA | 5146 | GuucAAAucuucAAAGAcAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1292-1311 | 5147 | UGUCUUUGAAGAUUUGAAC | 5148 | UGUCUUUGAAGAUUUGAACdTsdT | antis |
| 1293-1312 | 5149 | UUCAAAUCUUCAAAGACAC | 5150 | uucAAAucuucAAAGAcAcdTsdT | sense |
| 1293-1312 | 5151 | GUGUCUUUGAAGAUUUGAA | 5152 | GUGUCUUUGAAGAUUUGAAdTsdT | antis |
| 1294-1313 | 5153 | UCAAAUCUUCAAAGACACC | 5154 | ucAAAucuucAAAGAcAccdTsdT | sense |
| 1294-1313 | 5155 | GGUGUCUUUGAAGAUUUGA | 5156 | GGUGUCUUUGAAGAUUUGAdTsdT | antis |
| 1314-1333 | 5157 | CCUGAGGCCAUUGCACUCU | 5158 | ccuGAGGccAuuGcAcucudTsdT | sense |
| 1314-1333 | 5159 | AGAGUGCAAUGGCCUCAGG | 5160 | AGAGUGcAAUGGCCUcAGGdTsdT | antis |
| 1320-1339 | 5161 | GCCAUUGCACUCUGCUCUA | 5162 | GccAuuGcAcucuGcucuAdTsdT | sense |
| 1320-1339 | 5163 | UAGAGCAGAGUGCAAUGGC | 5164 | uAGAGcAGAGUGcAAUGGCdTsdT | antis |
| 1336-1355 | 5165 | CUAGCCUACUGGAGUACAC | 5166 | cuAGccuAcuGGAGuAcAcdTsdT | sense |
| 1336-1355 | 5167 | GUGUACUCCAGUAGGCUAG | 5168 | GUGuACUCcAGuAGGCuAGdTsdT | antis |
| 1353-1372 | 5169 | ACGCCAUCCUCAAGGCUCU | 5170 | AcGccAuccucAAGGcucudTsdT | sense |
| 1353-1372 | 5171 | AGAGCCUUGAGGAUGGCGU | 5172 | AGAGCCUUGAGGAUGGCGUdTsdT | antis |
| 1355-1374 | 5173 | GCCAUCCUCAAGGCUCUCC | 5174 | GccAuccucAAGGcucuccdTsdT | sense |
| 1355-1374 | 5175 | GGAGAGCCUUGAGGAUGGC | 5176 | GGAGAGCCUUGAGGAUGGCdTsdT | antis |
| 1359-1378 | 5177 | UCCUCAAGGCUCUCCCCAC | 5178 | uccucAAGGcucuccccAcdTsdT | sense |
| 1359-1378 | 5179 | GUGGGGAGAGCCUUGAGGA | 5180 | GUGGGGAGAGCCUUGAGGAdTsdT | antis |
| 1372-1391 | 5181 | CCCCACUCGAGGCUUGUGC | 5182 | ccccAcucGAGGcuuGuGcdTsdT | sense |
| 1372-1391 | 5183 | GCACAAGCCUCGAGUGGGG | 5184 | GcAcAAGCCUCGAGUGGGGdTsdT | antis |
| 1373-1392 | 5185 | CCCACUCGAGGCUUGUGCC | 5186 | cccAcucGAGGcuuGuGccdTsdT | sense |
| 1373-1392 | 5187 | GGCACAAGCCUCGAGUGGG | 5188 | GGcAcAAGCCUCGAGUGGGdTsdT | antis |
| 1374-1393 | 5189 | CCACUCGAGGCUUGUGCCC | 5190 | ccAcucGAGGcuuGuGcccdTsdT | sense |
| 1374-1393 | 5191 | GGGCACAAGCCUCGAGUGG | 5192 | GGGcAcAAGCCUCGAGUGGdTsdT | antis |
| 1376-1395 | 5193 | ACUCGAGGCUUGUGCCCAC | 5194 | AcucGAGGcuuGuGcccAcdTsdT | sense |
| 1376-1395 | 5195 | GUGGGCACAAGCCUCGAGU | 5196 | GUGGGcAcAAGCCUCGAGUdTsdT | antis |
| 1377-1396 | 5197 | CUCGAGGCUUGUGCCCACA | 5198 | cucGAGGcuuGuGcccAcAdTsdT | sense |
| 1377-1396 | 5199 | UGUGGGCACAAGCCUCGAG | 5200 | UGUGGGcAcAAGCCUCGAGdTsdT | antis |
| 1378-1397 | 5201 | UCGAGGCUUGUGCCCACAG | 5202 | ucGAGGcuuGuGcccAcAGdTsdT | sense |
| 1378-1397 | 5203 | CUGUGGGCACAAGCCUCGA | 5204 | CUGUGGGcAcAAGCCUCGAdTsdT | antis |
| 1389-1408 | 5205 | GCCCACAGCUUCUUCGAUG | 5206 | GcccAcAGcuucuucGAuGdTsdT | sense |
| 1389-1408 | 5207 | CAUCGAAGAAGCUGUGGGC | 5208 | cAUCGAAGAAGCUGUGGGCdTsdT | antis |
| 1391-1410 | 5209 | CCACAGCUUCUUCGAUGAA | 5210 | ccAcAGcuucuucGAuGAAdTsdT | sense |
| 1391-1410 | 5211 | UUCAUCGAAGAAGCUGUGG | 5212 | UUcAUCGAAGAAGCUGUGGdTsdT | antis |
| 1423-1442 | 5213 | GAGCCCAGCUCCCCAACGA | 5214 | GAGcccAGcuccccAAcGAdTsdT | sense |
| 1423-1442 | 5215 | UCGUUGGGGAGCUGGGCUC | 5216 | UCGUUGGGGAGCUGGGCUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1469-1488 | 5217 | CAGUCCUGGUGAACUGUCC | 5218 | cAGuccuGGuGAAcuGuccdTsdT | sense |
| 1469-1488 | 5219 | GGACAGUUCACCAGGACUG | 5220 | GGAcAGUUcACcAGGACUGdTsdT | antis |
| 1484-1503 | 5221 | GUCCAUCCAACCAUCUCUC | 5222 | GuccAuccAAccAucucucdTsdT | sense |
| 1484-1503 | 5223 | GAGAGAUGGUUGGAUGGAC | 5224 | GAGAGAUGGUUGGAUGGACdTsdT | antis |
| 1496-1515 | 5225 | AUCUCUCAAUGCCAUUCUC | 5226 | AucucucAAuGccAuucucdTsdT | sense |
| 1496-1515 | 5227 | GAGAAUGGCAUUGAGAGAU | 5228 | GAGAAUGGcAUUGAGAGAUdTsdT | antis |
| 1498-1517 | 5229 | CUCUCAAUGCCAUUCUCAU | 5230 | cucucAAuGccAuucucAudTsdT | sense |
| 1498-1517 | 5231 | AUGAGAAUGGCAUUGAGAG | 5232 | AUGAGAAUGGcAUUGAGAGdTsdT | antis |
| 1499-1518 | 5233 | UCUCAAUGCCAUUCUCAUC | 5234 | ucucAAuGccAuucucAucdTsdT | sense |
| 1499-1518 | 5235 | GAUGAGAAUGGCAUUGAGA | 5236 | GAUGAGAAUGGcAUUGAGAdTsdT | antis |
| 1502-1521 | 5237 | CAAUGCCAUUCUCAUCCCU | 5238 | cAAuGccAuucucAucccudTsdT | sense |
| 1502-1521 | 5239 | AGGGAUGAGAAUGGCAUUG | 5240 | AGGGAUGAGAAUGGcAUUGdTsdT | antis |
| 1541-1560 | 5241 | AGGCCCUGCUUCUCCCCUC | 5242 | AGGcccuGcuucuccccucdTsdT | sense |
| 1541-1560 | 5243 | GAGGGGAGAAGCAGGGCCU | 5244 | GAGGGGAGAAGcAGGGCCUdTsdT | antis |
| 1542-1561 | 5245 | GGCCCUGCUUCUCCCCUCA | 5246 | GGcccuGcuucuccccucAdTsdT | sense |
| 1542-1561 | 5247 | UGAGGGGAGAAGCAGGGCC | 5248 | UGAGGGGAGAAGcAGGGCCdTsdT | antis |
| 1548-1567 | 5249 | GCUUCUCCCCUCACCACUU | 5250 | GcuucuccccucAccAcuudTsdT | sense |
| 1548-1567 | 5251 | AAGUGGUGAGGGGAGAAGC | 5252 | AAGUGGUGAGGGGAGAAGCdTsdT | antis |
| 1549-1568 | 5253 | CUUCUCCCCUCACCACUUC | 5254 | cuucuccccucAccAcuucdTsdT | sense |
| 1549-1568 | 5255 | GAAGUGGUGAGGGGAGAAG | 5256 | GAAGUGGUGAGGGGAGAAGdTsdT | antis |
| 1552-1571 | 5257 | CUCCCCUCACCACUUCCUA | 5258 | cuccccucAccAcuuccuAdTsdT | sense |
| 1552-1571 | 5259 | UAGGAAGUGGUGAGGGGAG | 5260 | uAGGAAGUGGUGAGGGGAGdTsdT | antis |
| 1557-1576 | 5261 | CUCACCACUUCCUACAACC | 5262 | cucAccAcuuccuAcAAccdTsdT | sense |
| 1557-1576 | 5263 | GGUUGUAGGAAGUGGUGAG | 5264 | GGUUGuAGGAAGUGGUGAGdTsdT | antis |
| 1575-1594 | 5265 | CCAUCCUCACAAGCUUUAA | 5266 | ccAuccucAcAAGcuuuAAdTsdT | sense |
| 1575-1594 | 5267 | UUAAAGCUUGUGAGGAUGG | 5268 | UuAAAGCUUGUGAGGAUGGdTsdT | antis |
| 1600-1619 | 5269 | CUCAGACUGGCCAAGAUUG | 5270 | cucAGAcuGGccAAGAuuGdTsdT | sense |
| 1600-1619 | 5271 | CAAUCUUGGCCAGUCUGAG | 5272 | cAAUCUUGGCcAGUCUGAGdTsdT | antis |
| 1616-1635 | 5273 | UUGGCAGCCAUCUGAUGCC | 5274 | uuGGcAGccAucuGAuGccdTsdT | sense |
| 1616-1635 | 5275 | GGCAUCAGAUGGCUGCCAA | 5276 | GGcAUcAGAUGGCUGCcAAdTsdT | antis |
| 1617-1636 | 5277 | UGGCAGCCAUCUGAUGCCA | 5278 | uGGcAGccAucuGAuGccAdTsdT | sense |
| 1617-1636 | 5279 | UGGCAUCAGAUGGCUGCCA | 5280 | UGGcAUcAGAUGGCUGCcAdTsdT | antis |
| 1618-1637 | 5281 | GGCAGCCAUCUGAUGCCAC | 5282 | GGcAGccAucuGAuGccAcdTsdT | sense |
| 1618-1637 | 5283 | GUGGCAUCAGAUGGCUGCC | 5284 | GUGGcAUcAGAUGGCUGCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1619-1638 | 5285 | GCAGCCAUCUGAUGCCACA | 5286 | GcAGccAucuGAuGccAcAdTsdT | sense |
| 1619-1638 | 5287 | UGUGGCAUCAGAUGGCUGC | 5288 | UGUGGcAUcAGAUGGCUGCdTsdT | antis |
| 1622-1641 | 5289 | GCCAUCUGAUGCCACAACU | 5290 | GccAucuGAuGccAcAAcudTsdT | sense |
| 1622-1641 | 5291 | AGUUGUGGCAUCAGAUGGC | 5292 | AGUUGUGGcAUcAGAUGGCdTsdT | antis |
| 1647-1666 | 5293 | CUCGCUAGCUCUUCCUGAG | 5294 | cucGcuAGcucuuccuGAGdTsdT | sense |
| 1647-1666 | 5295 | CUCAGGAAGAGCUAGCGAG | 5296 | CUcAGGAAGAGCuAGCGAGdTsdT | antis |
| 1648-1667 | 5297 | UCGCUAGCUCUUCCUGAGG | 5298 | ucGcuAGcucuuccuGAGGdTsdT | sense |
| 1648-1667 | 5299 | CCUCAGGAAGAGCUAGCGA | 5300 | CCUcAGGAAGAGCuAGCGAdTsdT | antis |
| 1649-1668 | 5301 | CGCUAGCUCUUCCUGAGGG | 5302 | cGcuAGcucuuccuGAGGGdTsdT | sense |
| 1649-1668 | 5303 | CCCUCAGGAAGAGCUAGCG | 5304 | CCCUcAGGAAGAGCuAGCGdTsdT | antis |
| 1658-1677 | 5305 | UUCCUGAGGGCCCCACCGA | 5306 | uuccuGAGGGccccAccGAdTsdT | sense |
| 1658-1677 | 5307 | UCGGUGGGGCCCUCAGGAA | 5308 | UCGGUGGGGCCCUcAGGAAdTsdT | antis |
| 1661-1680 | 5309 | CUGAGGGCCCCACCGACUA | 5310 | cuGAGGGccccAccGAcuAdTsdT | sense |
| 1661-1680 | 5311 | UAGUCGGUGGGGCCCUCAG | 5312 | uAGUCGGUGGGGCCCUcAGdTsdT | antis |
| 1662-1681 | 5313 | UGAGGGCCCCACCGACUAC | 5314 | uGAGGGccccAccGAcuAcdTsdT | sense |
| 1662-1681 | 5315 | GUAGUCGGUGGGGCCCUCA | 5316 | GuAGUCGGUGGGGCCCUcAdTsdT | antis |
| 1663-1682 | 5317 | GAGGGCCCCACCGACUACC | 5318 | GAGGGccccAccGAcuAccdTsdT | sense |
| 1663-1682 | 5319 | GGUAGUCGGUGGGGCCCUC | 5320 | GGuAGUCGGUGGGGCCCUCdTsdT | antis |
| 1800-1819 | 5321 | AUCUAGGCCUCCCUCAGCA | 5322 | AucuAGGccucccucAGcAdTsdT | sense |
| 1800-1819 | 5323 | UGCUGAGGGAGGCCUAGAU | 5324 | UGCUGAGGGAGGCCuAGAUdTsdT | antis |
| 1807-1826 | 5325 | CCUCCCUCAGCAGCCUAAC | 5326 | ccucccucAGcAGccuAAcdTsdT | sense |
| 1807-1826 | 5327 | GUUAGGCUGCUGAGGGAGG | 5328 | GUuAGGCUGCUGAGGGAGGdTsdT | antis |
| 1819-1838 | 5329 | GCCUAACCUCUGUGGUGGG | 5330 | GccuAAccucuGuGGuGGGdTsdT | sense |
| 1819-1838 | 5331 | CCCACCACAGAGGUUAGGC | 5332 | CCcACcAcAGAGGUuAGGCdTsdT | antis |
| 1856-1875 | 5333 | AACUGUUUGUAGGGGAGGG | 5334 | AAcuGuuuGuAGGGGAGGGdTsdT | sense |
| 1856-1875 | 5335 | CCCUCCCCUACAAACAGUU | 5336 | CCCUCCCCuAcAAAcAGUUdTsdT | antis |
| 1860-1879 | 5337 | GUUUGUAGGGGAGGGGAGA | 5338 | GuuuGuAGGGGAGGGGAGAdTsdT | sense |
| 1860-1879 | 5339 | UCUCCCCUCCCCUACAAAC | 5340 | UCUCCCCUCCCCuAcAAACdTsdT | antis |
| 1864-1883 | 5341 | GUAGGGGAGGGGAGAAAAG | 5342 | GuAGGGGAGGGGAGAAAAGdTsdT | sense |
| 1864-1883 | 5343 | CUUUUCUCCCCUCCCCUAC | 5344 | CUUUUCUCCCCUCCCCuACdTsdT | antis |
| 1879-1898 | 5345 | AAAGGAAGGACGGGGUUUG | 5346 | AAAGGAAGGAcGGGGuuuGdTsdT | sense |
| 1879-1898 | 5347 | CAAACCCCGUCCUUCCUUU | 5348 | cAAACCCCGUCCUUCCUUUdTsdT | antis |
| 1880-1899 | 5349 | AAGGAAGGACGGGGUUUGG | 5350 | AAGGAAGGAcGGGGuuuGGdTsdT | sense |
| 1880-1899 | 5351 | CCAAACCCCGUCCUUCCUU | 5352 | CcAAACCCCGUCCUUCCUUdTsdT | antis |
| 1881-1900 | 5353 | AGGAAGGACGGGGUUUGGG | 5354 | AGGAAGGAcGGGGuuuGGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1881-1900 | 5355 | CCCAAACCCCGUCCUUCCU | 5356 | CCcAAACCCCGUCCUUCCUdTsdT | antis |
| 1906-1925 | 5357 | AGGACCUUCUACCCCCUUG | 5358 | AGGAccuucuAcccccuuGdTsdT | sense |
| 1906-1925 | 5359 | CAAGGGGGUAGAAGGUCCU | 5360 | cAAGGGGGuAGAAGGUCCUdTsdT | antis |
| 1907-1926 | 5361 | GGACCUUCUACCCCCUUGG | 5362 | GGAccuucuAcccccuuGGdTsdT | sense |
| 1907-1926 | 5363 | CCAAGGGGGUAGAAGGUCC | 5364 | CcAAGGGGGuAGAAGGUCCdTsdT | antis |
| 1908-1927 | 5365 | GACCUUCUACCCCCUUGGU | 5366 | GAccuucuAcccccuuGGudTsdT | sense |
| 1908-1927 | 5367 | ACCAAGGGGGUAGAAGGUC | 5368 | ACcAAGGGGGuAGAAGGUCdTsdT | antis |
| 1909-1928 | 5369 | ACCUUCUACCCCCUUGGUC | 5370 | AccuucuAcccccuuGucdTsdT | sense |
| 1909-1928 | 5371 | GACCAAGGGGGUAGAAGGU | 5372 | GACcAAGGGGGuAGAAGGUdTsdT | antis |
| 1910-1929 | 5373 | CCUUCUACCCCCUUGGUCC | 5374 | ccuucuAcccccuuGGuccdTsdT | sense |
| 1910-1929 | 5375 | GGACCAAGGGGGUAGAAGG | 5376 | GGACcAAGGGGGuAGAAGGdTsdT | antis |
| 1911-1930 | 5377 | CUUCUACCCCCUUGGUCCC | 5378 | cuucuAcccccuuGGucccdTsdT | sense |
| 1911-1930 | 5379 | GGGACCAAGGGGGUAGAAG | 5380 | GGGACcAAGGGGGuAGAAGdTsdT | antis |
| 1932-1951 | 5381 | CCCCUCCCCCAGGCUACCA | 5382 | cccccuccccAGGcuAccAdTsdT | sense |
| 1932-1951 | 5383 | UGGUAGCCUGGGGGAGGGG | 5384 | UGGuAGCCUGGGGGAGGGGdTsdT | antis |
| 1942-1961 | 5385 | AGGCUACCACUCCUUCCCU | 5386 | AGGcuAccAcuccuucccudTsdT | sense |
| 1942-1961 | 5387 | AGGGAAGGAGUGGUAGCCU | 5388 | AGGGAAGGAGUGGuAGCCUdTsdT | antis |
| 1943-1962 | 5389 | GGCUACCACUCCUUCCCUC | 5390 | GGcuAccAcuccuucccucdTsdT | sense |
| 1943-1962 | 5391 | GAGGGAAGGAGUGGUAGCC | 5392 | GAGGGAAGGAGUGGuAGCCdTsdT | antis |
| 1958-1977 | 5393 | CCUCCCCCCCUCUCCCAGG | 5394 | ccucccccccucucccAGGdTsdT | sense |
| 1958-1977 | 5395 | CCUGGGAGAGGGGGGAGG | 5396 | CCUGGGAGAGGGGGGGAGGdTsdT | antis |
| 1961-1980 | 5397 | CCCCCCCUCUCCCAGGUCC | 5398 | ccccccucucccAGGuccdTsdT | sense |
| 1961-1980 | 5399 | GGACCUGGGAGAGGGGGGG | 5400 | GGACCUGGGAGAGGGGGGGGdTsdT | antis |
| 1966-1985 | 5401 | CCUCUCCCAGGUCCCUUGU | 5402 | ccucucccAGGucccuuGudTsdT | sense |
| 1966-1985 | 5403 | ACAAGGGACCUGGGAGAGG | 5404 | AcAAGGGACCUGGGAGAGGdTsdT | antis |
| 1972-1991 | 5405 | CCAGGUCCCUUGUAAAUAG | 5406 | ccAGGucccuuGuAAAuAGdTsdT | sense |
| 1972-1991 | 5407 | CUAUUUACAAGGGACCUGG | 5408 | CuAUUuAcAAGGGACCUGGdTsdT | antis |
| 1989-2008 | 5409 | AGAACCAGCCCAGCCCAUC | 5410 | AGAAccAGcccAGcccAucdTsdT | sense |
| 1989-2008 | 5411 | GAUGGGCUGGGCUGGUUCU | 5412 | GAUGGGCUGGGCUGGUUCUdTsdT | antis |
| 1990-2009 | 5413 | GAACCAGCCCAGCCCAUCU | 5414 | GAAccAGcccAGcccAucudTsdT | sense |
| 1990-2009 | 5415 | AGAUGGGCUGGGCUGGUUC | 5416 | AGAUGGGCUGGGCUGGUUCdTsdT | antis |
| 1991-2010 | 5417 | AACCAGCCCAGCCCAUCUC | 5418 | AAccAGcccAGcccAucucdTsdT | sense |
| 1991-2010 | 5419 | GAGAUGGGCUGGGCUGGUU | 5420 | GAGAUGGGCUGGGCUGGUUdTsdT | antis |
| 1992-2011 | 5421 | ACCAGCCCAGCCCAUCUCU | 5422 | AccAGcccAGcccAucucudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1992-2011 | 5423 | AGAGAUGGGCUGGGCUGGU | 5424 | AGAGAUGGGCUGGGCUGGUdTsdT | antis |
| 1993-2012 | 5425 | CCAGCCCAGCCCAUCUCUC | 5426 | ccAGcccAGcccAucucucdTsdT | sense |
| 1993-2012 | 5427 | GAGAGAUGGGCUGGGCUGG | 5428 | GAGAGAUGGGCUGGGCUGGdTsdT | antis |
| 2007-2026 | 5429 | CUCUCGUCUUCCCUUCCCU | 5430 | cucucGucuucccuucccudTsdT | sense |
| 2007-2026 | 5431 | AGGGAAGGGAAGACGAGAG | 5432 | AGGGAAGGGAAGACGAGAGdTsdT | antis |
| 2008-2027 | 5433 | UCUCGUCUUCCCUUCCCUG | 5434 | ucucGucuucccuucccuGdTsdT | sense |
| 2008-2027 | 5435 | CAGGGAAGGGAAGACGAGA | 5436 | cAGGGAAGGGAAGACGAGAdTsdT | antis |
| 2013-2032 | 5437 | UCUUCCCUUCCCUGGCCCC | 5438 | ucuucccuucccuGGccccdTsdT | sense |
| 2013-2032 | 5439 | GGGGCCAGGGAAGGGAAGA | 5440 | GGGGCcAGGGAAGGGAAGAdTsdT | antis |
| 2014-2033 | 5441 | CUUCCCUUCCCUGGCCCCC | 5442 | cuucccuucccuGGcccccdTsdT | sense |
| 2014-2033 | 5443 | GGGGGCCAGGGAAGGGAAG | 5444 | GGGGGCcAGGGAAGGGAAGdTsdT | antis |
| 2021-2040 | 5445 | UCCCUGGCCCCCUGGGUGU | 5446 | ucccuGGcccccuGGGuGudTsdT | sense |
| 2021-2040 | 5447 | ACACCCAGGGGCCAGGGA | 5448 | AcACCcAGGGGCcAGGGAdTsdT | antis |
| 2038-2057 | 5449 | GUAAAUAGAUUGUUAUAAU | 5450 | GuAAAuAGAuuGuuAuAAudTsdT | sense |
| 2038-2057 | 5451 | AUUAUAACAAUCUAUUUAC | 5452 | AUuAuAAcAAUCuAUUuACdTsdT | antis |
| 2048-2067 | 5453 | UGUUAUAAUUUUUUCUUAA | 5454 | uGuuAuAAuuuuuucuuAAdTsdT | sense |
| 2048-2067 | 5455 | UUAAGAAAAAAUUAUAACA | 5456 | UuAAGAAAAAAUuAuAAcAdTsdT | antis |
| 2106-2125 | 5457 | GCUGUACCCCUUCUUGUCC | 5458 | GcuGuAccccuucuuGuccdTsdT | sense |
| 2106-2125 | 5459 | GGACAAGAAGGGGUACAGC | 5460 | GGAcAAGAAGGGGuAcAGCdTsdT | antis |
| 2109-2128 | 5461 | GUACCCCUUCUUGUCCUCU | 5462 | GuAccccuucuuGuccucudTsdT | sense |
| 2109-2128 | 5463 | AGAGGACAAGAAGGGGUAC | 5464 | AGAGGAcAAGAAGGGGuACdTsdT | antis |
| 2120-2139 | 5465 | UGUCCUCUGCUCCCAAGGC | 5466 | uGuccucuGcucccAAGGcdTsdT | sense |
| 2120-2139 | 5467 | GCCUUGGGAGCAGAGGACA | 5468 | GCCUUGGGAGcAGAGGAcAdTsdT | antis |
| 2170-2189 | 5469 | AGUAGAGAGAGUCCCUGGU | 5470 | AGuAGAGAGAGucccuGGudTsdT | sense |
| 2170-2189 | 5471 | ACCAGGGACUCUCUCUACU | 5472 | ACcAGGGACUCUCUCuACUdTsdT | antis |
| 2180-2199 | 5473 | GUCCCUGGUGUCUUAGUUU | 5474 | GucccuGGuGucuuAGuuudTsdT | sense |
| 2180-2199 | 5475 | AAACUAAGACACCAGGGAC | 5476 | AAACuAAGAcAccAGGGACdTsdT | antis |
| 2187-2206 | 5477 | GUGUCUUAGUUUCCACAGU | 5478 | GuGucuuAGuuuccAcAGudTsdT | sense |
| 2187-2206 | 5479 | ACUGUGGAAACUAAGACAC | 5480 | ACUGUGGAAACuAAGAcACdTsdT | antis |
| 2189-2208 | 5481 | GUCUUAGUUUCCACAGUAA | 5482 | GucuuAGuuuccAcAGuAAdTsdT | sense |
| 2189-2208 | 5483 | UUACUGUGGAAACUAAGAC | 5484 | UuACUGUGGAAACuAAGACdTsdT | antis |
| 2190-2209 | 5485 | UCUUAGUUUCCACAGUAAG | 5486 | ucuuAGuuuccAcAGuAAGdTsdT | sense |
| 2190-2209 | 5487 | CUUACUGUGGAAACUAAGA | 5488 | CUuACUGUGGAAACuAAGAdTsdT | antis |
| 2225-2244 | 5489 | ACCUCUGUUCAAUAAAUUA | 5490 | AccucuGuucAAuAAAuuAdTsdT | sense |
| 2225-2244 | 5491 | UAAUUUAUUGAACAGAGGU | 5492 | uAAUUuAUUGAAcAGAGGUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2238-2257 | 5493 | AAAUUAUUGGCAUGAAACC | 5494 | AAAuuAuuGGcAuGAAAccdTsdT | sense |
| 2238-2257 | 5495 | GGUUUCAUGCCAAUAAUUU | 5496 | GGUUUcAUGCcAAuAAUUUdTsdT | antis |
| 2239-2258 | 5497 | AAUUAUUGGCAUGAAACCC | 5498 | AAuuAuuGGcAuGAAAcccdTsdT | sense |
| 2239-2258 | 5499 | GGGUUUCAUGCCAAUAAUU | 5500 | GGGUUUcAUGCcAAuAAUUdTsdT | antis |
| 2241-2260 | 5501 | UUAUUGGCAUGAAACCCUU | 5502 | uuAuuGGcAuGAAAcccuudTsdT | sense |
| 2241-2260 | 5503 | AAGGGUUUCAUGCCAAUAA | 5504 | AAGGGUUUcAUGCcAAuAAdTsdT | antis |
| 34-53 | 5505 | CAUCUCCCGGCGUGCCCCG | 5506 | cAucuccCGGcGuGccccGdTsdT | sense |
| 34-53 | 5507 | CGGGGCACGCCGGGAGAUG | 5508 | CGGGGcACGCCGGGAGAUGdTsdT | antis |
| 35-54 | 5509 | AUCUCCCGGCGUGCCCCGC | 5510 | AucucccGGcGuGccccGcdTsdT | sense |
| 35-54 | 5511 | GCGGGGCACGCCGGGAGAU | 5512 | GCGGGGcACGCCGGGAGAUdTsdT | antis |
| 97-116 | 5513 | GAAGAGGCCGGAGCCCAGG | 5514 | GAAGAGGccGGAGcccAGGdTsdT | sense |
| 97-116 | 5515 | CCUGGGCUCCGGCCUCUUC | 5516 | CCUGGGCUCCGGCCUCUUCdTsdT | antis |
| 163-182 | 5517 | CCCCGCGGCCUGGGCCUGC | 5518 | ccccGcGGccuGGGccuGcdTsdT | sense |
| 163-182 | 5519 | GCAGGCCCAGGCCGCGGGG | 5520 | GcAGGCCcAGGCCGCGGGGdTsdT | antis |
| 164-183 | 5521 | CCCGCGGCCUGGGCCUGCG | 5522 | cccGcGGccuGGGccuGcGdTsdT | sense |
| 164-183 | 5523 | CGCAGGCCCAGGCCGCGGG | 5524 | CGcAGGCCcAGGCCGCGGGdTsdT | antis |
| 228-247 | 5525 | GGCUCGGGCCGGGCGCGGA | 5526 | GGcucGGGccGGGcGcGGAdTsdT | sense |
| 228-247 | 5527 | UCCGCGCCCGGCCCGAGCC | 5528 | UCCGCGCCCGGCCCGAGCCdTsdT | antis |
| 235-254 | 5529 | GCCGGGCGCGGACCAGCUC | 5530 | GccGGGcGcGGAccAGcucdTsdT | sense |
| 235-254 | 5531 | GAGCUGGUCCGCGCCCGGC | 5532 | GAGCUGGUCCGCGCCCGGCdTsdT | antis |
| 247-266 | 5533 | CCAGCUCGUUCGCGGAGCC | 5534 | ccAGcucGuucGcGGAGccdTsdT | sense |
| 247-266 | 5535 | GGCUCCGCGAACGAGCUGG | 5536 | GGCUCCGCGAACGAGCUGGdTsdT | antis |
| 262-281 | 5537 | AGCCAGGAGGCGGAGGCGG | 5538 | AGccAGGAGGcGGAGGcGGdTsdT | sense |
| 262-281 | 5539 | CCGCCUCCGCCUCCUGGCU | 5540 | CCGCCUCCGCCUCCUGGCUdTsdT | antis |
| 301-320 | 5541 | GGGGCUCGGCCUCUGGCCC | 5542 | GGGGcucGGccucuGGcccdTsdT | sense |
| 301-320 | 5543 | GGGCCAGAGGCCGAGCCCC | 5544 | GGGCcAGAGGCCGAGCCCCdTsdT | antis |
| 393-412 | 5545 | GGCCCCAGCGGCAGCGGCG | 5546 | GGccccAGcGGcAGcGGcGdTsdT | sense |
| 393-412 | 5547 | CGCCGCUGCCGCUGGGGCC | 5548 | CGCCGCUGCCGCUGGGGCCdTsdT | antis |
| 403-422 | 5549 | GCAGCGGCGGAGGAGGCAG | 5550 | GcAGcGGcGGAGGAGGcAGdTsdT | sense |
| 403-422 | 5551 | CUGCCUCCUCCGCCGCUGC | 5552 | CUGCCUCCUCCGCCGCUGCdTsdT | antis |
| 420-439 | 5553 | AGCGGUGGCCCCGGCGCGG | 5554 | AGcGGuGGccccGGcGcGGdTsdT | sense |
| 420-439 | 5555 | CCGCGCCGGGGCCACCGCU | 5556 | CCGCGCCGGGGCcACCGCUdTsdT | antis |
| 502-521 | 5557 | UAGCCACUGUAGGCCAAGG | 5558 | uAGccAcuGuAGGccAAGGdTsdT | sense |
| 502-521 | 5559 | CCUUGGCCUACAGUGGCUA | 5560 | CCUUGGCCuAcAGUGGCuAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 531-550 | 5561 | UCCCAAGAAGUGGCUUACA | 5562 | ucccAAGAAGuGGcuuAcAdTsdT | sense |
| 531-550 | 5563 | UGUAAGCCACUUCUUGGGA | 5564 | UGuAAGCcACUUCUUGGGAdTsdT | antis |
| 665-684 | 5565 | CCGAGAACUGCAGAUUAUG | 5566 | ccGAGAAcuGcAGAuuAuGdTsdT | sense |
| 665-684 | 5567 | CAUAAUCUGCAGUUCUCGG | 5568 | cAuAAUCUGcAGUUCUCGGdTsdT | antis |
| 1148-1167 | 5569 | CUUCCCUGGGGACAGUGGG | 5570 | cuucccuGGGGAcAGuGGGdTsdT | sense |
| 1148-1167 | 5571 | CCCACUGUCCCCAGGGAAG | 5572 | CCcACUGUCCCcAGGGAAGdTsdT | antis |
| 1356-1375 | 5573 | CCAUCCUCAAGGCUCUCCC | 5574 | ccAuccucAAGGcucucccdTsdT | sense |
| 1356-1375 | 5575 | GGGAGAGCCUUGAGGAUGG | 5576 | GGGAGAGCCUUGAGGAUGGdTsdT | antis |
| 1358-1377 | 5577 | AUCCUCAAGGCUCUCCCA | 5578 | AuccucAAGGcucuccccAdTsdT | sense |
| 1358-1377 | 5579 | UGGGGAGAGCCUUGAGGAU | 5580 | UGGGGAGAGCCUUGAGGAUdTsdT | antis |
| 1485-1504 | 5581 | UCCAUCCAACCAUCUCUCA | 5582 | uccAuccAAccAucucucAdTsdT | sense |
| 1485-1504 | 5583 | UGAGAGAUGGUUGGAUGGA | 5584 | UGAGAGAUGGUUGGAUGGAdTsdT | antis |
| 1620-1639 | 5585 | CAGCCAUCUGAUGCCACAA | 5586 | cAGccAucuGAuGccAcAAdTsdT | sense |
| 1620-1639 | 5587 | UUGUGGCAUCAGAUGGCUG | 5588 | UUGUGGcAUcAGAUGGCUGdTsdT | antis |
| 1813-1832 | 5589 | UCAGCAGCCUAACCUCUGU | 5590 | ucAGcAGccuAAccucuGudTsdT | sense |
| 1813-1832 | 5591 | ACAGAGGUUAGGCUGCUGA | 5592 | AcAGAGGUuAGGCUGCUGAdTsdT | antis |
| 1954-1973 | 5593 | CUUCCCUCCCCCCCUCUCC | 5594 | cuucccuccccccccucuccdTsdT | sense |
| 1954-1973 | 5595 | GGAGAGGGGGGAGGGAAG | 5596 | GGAGAGGGGGGAGGGAAGdTsdT | antis |
| 1957-1976 | 5597 | CCCUCCCCCCCUCUCCCAG | 5598 | cccucccccccucucccAGdTsdT | sense |
| 1957-1976 | 5599 | CUGGGAGAGGGGGGAGGG | 5600 | CUGGGAGAGGGGGGAGGGdTsdT | antis |
| 2103-2122 | 5601 | CCAGCUGUACCCCUUCUUG | 5602 | ccAGcuGuAccccuucuuGdTsdT | sense |
| 2103-2122 | 5603 | CAAGAAGGGGUACAGCUGG | 5604 | cAAGAAGGGGuAcAGCUGGdTsdT | antis |
| 2119-2138 | 5605 | UUGUCCUCUGCUCCCAAGG | 5606 | uuGuccucuGcucccAAGGdTsdT | sense |
| 2119-2138 | 5607 | CCUUGGGAGCAGAGGACAA | 5608 | CCUUGGGAGcAGAGGAcAAdTsdT | antis |
| 2122-2141 | 5609 | UCCUCUGCUCCCAAGGCUU | 5610 | uccucuGcucccAAGGcuudTsdT | sense |
| 2122-2141 | 5611 | AAGCCUUGGGAGCAGAGGA | 5612 | AAGCCUUGGGAGcAGAGGAdTsdT | antis |
| 2125-2144 | 5613 | UCUGCUCCCAAGGCUUCCU | 5614 | ucuGcucccAAGGcuuccudTsdT | sense |
| 2125-2144 | 5615 | AGGAAGCCUUGGGAGCAGA | 5616 | AGGAAGCCUUGGGAGcAGAdTsdT | antis |
| 2154-2173 | 5617 | AUCCUGGAAGGAGGGGAGU | 5618 | AuccuGGAAGGAGGGGAGudTsdT | sense |
| 2154-2173 | 5619 | ACUCCCCUCCUUCCAGGAU | 5620 | ACUCCCCUCCUUCcAGGAUdTsdT | antis |
| 33-52 | 5621 | UCAUCUCCCGGCGUGCCCC | 5622 | ucAucucccGGcGuGccccdTsdT | sense |
| 33-52 | 5623 | GGGGCACGCCGGGAGAUGA | 5624 | GGGGcACGCCGGGAGAUGAdTsdT | antis |
| 46-65 | 5625 | UGCCCCGCGGCGGGCGCUG | 5626 | uGccccGcGGcGGGcGcuGdTsdT | sense |
| 46-65 | 5627 | CAGCGCCCGCCGCGGGGCA | 5628 | cAGCGCCCGCCGCGGGGcAdTsdT | antis |
| 47-66 | 5629 | GCCCCGCGGCGGGCGCUGG | 5630 | GccccGcGGcGGGcGcuGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 47-66 | 5631 | CCAGCGCCCGCCGCGGGGC | 5632 | CcAGCGCCCGCCGCGGGGCdTsdT | antis |
| 53-72 | 5633 | CGGCGGGCGCUGGGCCGGA | 5634 | cGGcGGGcGcuGGGccGGAdTsdT | sense |
| 53-72 | 5635 | UCCGGCCCAGCGCCCGCCG | 5636 | UCCGGCCcAGCGCCCGCCGdTsdT | antis |
| 54-73 | 5637 | GGCGGGCGCUGGGCCGGAG | 5638 | GGcGGGcGcuGGGccGGAGdTsdT | sense |
| 54-73 | 5639 | CUCCGGCCCAGCGCCCGCC | 5640 | CUCCGGCCcAGCGCCCGCCdTsdT | antis |
| 55-74 | 5641 | GCGGGCGCUGGGCCGGAGC | 5642 | GcGGGcGcuGGGccGGAGCdTsdT | sense |
| 55-74 | 5643 | GCUCCGGCCCAGCGCCCGC | 5644 | GCUCCGGCCcAGCGCCCGCdTsdT | antis |
| 61-80 | 5645 | GCUGGGCCGGAGCCGGAGC | 5646 | GcuGGGccGGAGccGGAGCdTsdT | sense |
| 61-80 | 5647 | GCUCCGGCUCCGGCCCAGC | 5648 | GCUCCGGCUCCGGCCcAGCdTsdT | antis |
| 64-83 | 5649 | GGGCCGGAGCCGGAGCCCG | 5650 | GGGccGGAGccGGAGcccGdTsdT | sense |
| 64-83 | 5651 | CGGGCUCCGGCUCCGGCCC | 5652 | CGGGCUCCGGCUCCGGCCCdTsdT | antis |
| 67-86 | 5653 | CCGGAGCCGGAGCCCGAAC | 5654 | ccGGAGccGGAGcccGAAcdTsdT | sense |
| 67-86 | 5655 | GUUCGGGCUCCGGCUCCGG | 5656 | GUUCGGGCUCCGGCUCCGGdTsdT | antis |
| 92-111 | 5657 | GCCUGGAAGAGGCCGGAGC | 5658 | GccuGGAAGAGGccGGAGCdTsdT | sense |
| 92-111 | 5659 | GCUCCGGCCUCUUCCAGGC | 5660 | GCUCCGGCCUCUUCcAGGCdTsdT | antis |
| 93-112 | 5661 | CCUGGAAGAGGCCGGAGCC | 5662 | ccuGGAAGAGGccGGAGccdTsdT | sense |
| 93-112 | 5663 | GGCUCCGGCCUCUUCCAGG | 5664 | GGCUCCGGCCUCUUCcAGGdTsdT | antis |
| 101-120 | 5665 | AGGCCGGAGCCCAGGGGAG | 5666 | AGGccGGAGcccAGGGGAGdTsdT | sense |
| 101-120 | 5667 | CUCCCCUGGGCUCCGGCCU | 5668 | CUCCCCUGGGCUCCGGCCUdTsdT | antis |
| 102-121 | 5669 | GGCCGGAGCCCAGGGGAGG | 5670 | GGccGGAGcccAGGGGAGGdTsdT | sense |
| 102-121 | 5671 | CCUCCCCUGGGCUCCGGCC | 5672 | CCUCCCCUGGGCUCCGGCCdTsdT | antis |
| 106-125 | 5673 | GGAGCCCAGGGGAGGCGGC | 5674 | GGAGcccAGGGGAGGcGGcdTsdT | sense |
| 106-125 | 5675 | GCCGCCUCCCCUGGGCUCC | 5676 | GCCGCCUCCCCUGGGCUCCdTsdT | antis |
| 110-129 | 5677 | CCCAGGGGAGGCGGCGGCA | 5678 | cccAGGGGAGGcGGcGGcAdTsdT | sense |
| 110-129 | 5679 | UGCCGCCGCCUCCCCUGGG | 5680 | UGCCGCCGCCUCCCCUGGGdTsdT | antis |
| 111-130 | 5681 | CCAGGGGAGGCGGCGGCAG | 5682 | ccAGGGGAGGcGGcGGcAGdTsdT | sense |
| 111-130 | 5683 | CUGCCGCCGCCUCCCCUGG | 5684 | CUGCCGCCGCCUCCCCUGGdTsdT | antis |
| 122-141 | 5685 | GGCGGCAGAGGCAGCGGCG | 5686 | GGcGGcAGAGGcAGcGGcGdTsdT | sense |
| 122-141 | 5687 | CGCCGCUGCCUCUGCCGCC | 5688 | CGCCGCUGCCUCUGCCGCCdTsdT | antis |
| 123-142 | 5689 | GCGGCAGAGGCAGCGGCGG | 5690 | GcGGcAGAGGcAGcGGcGGdTsdT | sense |
| 123-142 | 5691 | CCGCCGCUGCCUCUGCCGC | 5692 | CCGCCGCUGCCUCUGCCGCdTsdT | antis |
| 124-143 | 5693 | CGGCAGAGGCAGCGGCGGG | 5694 | cGGcAGAGGcAGcGGcGGGdTsdT | sense |
| 124-143 | 5695 | CCCGCCGCUGCCUCUGCCG | 5696 | CCCGCCGCUGCCUCUGCCGdTsdT | antis |
| 125-144 | 5697 | GGCAGAGGCAGCGGCGGGG | 5698 | GGcAGAGGcAGcGGcGGGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 125-144 | 5699 | CCCCGCCGCUGCCUCUGCC | 5700 | CCCCGCCGCUGCCUCUGCCdTsdT | antis |
| 132-151 | 5701 | GCAGCGGCGGGGGCAGCCC | 5702 | GcAGcGGcGGGGGcAGcccdTsdT | sense |
| 132-151 | 5703 | GGGCUGCCCCCGCCGCUGC | 5704 | GGGCUGCCCCCGCCGCUGCdTsdT | antis |
| 139-158 | 5705 | CGGGGGCAGCCCAGGCAGC | 5706 | cGGGGGcAGcccAGGcAGcdTsdT | sense |
| 139-158 | 5707 | GCUGCCUGGGCUGCCCCCG | 5708 | GCUGCCUGGGCUGCCCCCGdTsdT | antis |
| 143-162 | 5709 | GGCAGCCCAGGCAGCCCGA | 5710 | GGcAGcccAGGcAGcccGAdTsdT | sense |
| 143-162 | 5711 | UCGGGCUGCCUGGGCUGCC | 5712 | UCGGGCUGCCUGGGCUGCCdTsdT | antis |
| 146-165 | 5713 | AGCCCAGGCAGCCCGAGCC | 5714 | AGcccAGGcAGcccGAGccdTsdT | sense |
| 146-165 | 5715 | GGCUCGGGCUGCCUGGGCU | 5716 | GGCUCGGGCUGCCUGGGCUdTsdT | antis |
| 152-171 | 5717 | GGCAGCCCGAGCCCCGCGG | 5718 | GGcAGcccGAGccccGcGGdTsdT | sense |
| 152-171 | 5719 | CCGCGGGGCUCGGGCUGCC | 5720 | CCGCGGGGCUCGGGCUGCCdTsdT | antis |
| 154-173 | 5721 | CAGCCCGAGCCCCGCGGCC | 5722 | cAGcccGAGccccGcGGccdTsdT | sense |
| 154-173 | 5723 | GGCCGCGGGGCUCGGGCUG | 5724 | GGCCGCGGGGCUCGGGCUGdTsdT | antis |
| 155-174 | 5725 | AGCCCGAGCCCCGCGGCCU | 5726 | AGcccGAGccccGcGGccudTsdT | sense |
| 155-174 | 5727 | AGGCCGCGGGGCUCGGGCU | 5728 | AGGCCGCGGGGCUCGGGCUdTsdT | antis |
| 156-175 | 5729 | GCCCGAGCCCCGCGGCCUG | 5730 | GcccGAGccccGcGGccuGdTsdT | sense |
| 156-175 | 5731 | CAGGCCGCGGGGCUCGGGC | 5732 | cAGGCCGCGGGGCUCGGGCdTsdT | antis |
| 159-178 | 5733 | CGAGCCCCGCGGCCUGGGC | 5734 | cGAGccccGcGGccuGGGcdTsdT | sense |
| 159-178 | 5735 | GCCCAGGCCGCGGGGCUCG | 5736 | GCCcAGGCCGCGGGGCUCGdTsdT | antis |
| 160-179 | 5737 | GAGCCCCGCGGCCUGGGCC | 5738 | GAGccccGcGGccuGGGccdTsdT | sense |
| 160-179 | 5739 | GGCCCAGGCCGCGGGGCUC | 5740 | GGCCcAGGCCGCGGGGCUCdTsdT | antis |
| 161-180 | 5741 | AGCCCCGCGGCCUGGGCCU | 5742 | AGccccGcGGccuGGGccudTsdT | sense |
| 161-180 | 5743 | AGGCCCAGGCCGCGGGGCU | 5744 | AGGCCcAGGCCGCGGGGCUdTsdT | antis |
| 162-181 | 5745 | GCCCCGCGGCCUGGGCCUG | 5746 | GccccGcGGccuGGGccuGdTsdT | sense |
| 162-181 | 5747 | CAGGCCCAGGCCGCGGGGC | 5748 | cAGGCCcAGGCCGCGGGGCdTsdT | antis |
| 174-193 | 5749 | GGGCCUGCGCUCGGCGCCA | 5750 | GGGccuGcGcucGGcGccAdTsdT | sense |
| 174-193 | 5751 | UGGCGCCGAGCGCAGGCCC | 5752 | UGGCGCCGAGCGcAGGCCCdTsdT | antis |
| 210-229 | 5753 | UCGGGAGGCGGCCCUGGGG | 5754 | ucGGGAGGcGGcccuGGGGdTsdT | sense |
| 210-229 | 5755 | CCCCAGGGCCGCCUCCCGA | 5756 | CCCcAGGGCCGCCUCCCGAdTsdT | antis |
| 211-230 | 5757 | CGGGAGGCGGCCCUGGGGG | 5758 | cGGGAGGcGGcccuGGGGGdTsdT | sense |
| 211-230 | 5759 | CCCCAGGGCCGCCUCCCG | 5760 | CCCCcAGGGCCGCCUCCCGdTsdT | antis |
| 212-231 | 5761 | GGGAGGCGGCCCUGGGGGC | 5762 | GGGAGGcGGcccuGGGGGcdTsdT | sense |
| 212-231 | 5763 | GCCCCAGGGCCGCCUCCC | 5764 | GCCCcAGGGCCGCCUCCCdTsdT | antis |
| 217-236 | 5765 | GCGGCCCUGGGGGCUCGGG | 5766 | GcGGcccuGGGGGcucGGGdTsdT | sense |
| 217-236 | 5767 | CCCGAGCCCCCAGGGCCGC | 5768 | CCCGAGCCCCcAGGGCCGCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 218-237 | 5769 | CGGCCCUGGGGGCUCGGGC | 5770 | cGGcccuGGGGGcucGGGcdTsdT | sense |
| 218-237 | 5771 | GCCCGAGCCCCCAGGGCCG | 5772 | GCCCGAGCCCCcAGGGCCGdTsdT | antis |
| 225-244 | 5773 | GGGGGCUCGGGCCGGGCGC | 5774 | GGGGGcucGGGccGGGcGcdTsdT | sense |
| 225-244 | 5775 | GCGCCCGGCCCGAGCCCCC | 5776 | GCGCCCGGCCCGAGCCCCCdTsdT | antis |
| 226-245 | 5777 | GGGGCUCGGGCCGGGCGCG | 5778 | GGGGcucGGGccGGGcGcGdTsdT | sense |
| 226-245 | 5779 | CGCGCCCGGCCCGAGCCCC | 5780 | CGCGCCCGGCCCGAGCCCCdTsdT | antis |
| 232-251 | 5781 | CGGGCCGGGCGCGGACCAG | 5782 | cGGGccGGGcGcGGAccAGdTsdT | sense |
| 232-251 | 5783 | CUGGUCCGCGCCCGGCCCG | 5784 | CUGGUCCGCGCCCGGCCCGdTsdT | antis |
| 260-279 | 5785 | GGAGCCAGGAGGCGGAGGC | 5786 | GGAGccAGGAGGcGGAGGcdTsdT | sense |
| 260-279 | 5787 | GCCUCCGCCUCCUGGCUCC | 5788 | GCCUCCGCCUCCUGGCUCCdTsdT | antis |
| 263-282 | 5789 | GCCAGGAGGCGGAGGCGGA | 5790 | GccAGGAGGcGGAGGcGGAdTsdT | sense |
| 263-282 | 5791 | UCCGCCUCCGCCUCCUGGC | 5792 | UCCGCCUCCGCCUCCUGGCdTsdT | antis |
| 264-283 | 5793 | CCAGGAGGCGGAGGCGGAG | 5794 | ccAGGAGGcGGAGGcGGAGdTsdT | sense |
| 264-283 | 5795 | CUCCGCCUCCGCCUCCUGG | 5796 | CUCCGCCUCCGCCUCCUGGdTsdT | antis |
| 270-289 | 5797 | GGCGGAGGCGGAGGUGGUG | 5798 | GGcGGAGGcGGAGGuGGuGdTsdT | sense |
| 270-289 | 5799 | CACCACCUCCGCCUCCGCC | 5800 | cAccACCUCCGCCUCCGCCdTsdT | antis |
| 280-299 | 5801 | GAGGUGGUGGCGGCGGCCC | 5802 | GAGGuGGuGGcGGcGGcccdTsdT | sense |
| 280-299 | 5803 | GGGCCGCCGCCACCACCUC | 5804 | GGGCCGCCGCCAccACCUCdTsdT | antis |
| 281-300 | 5805 | AGGUGGUGGCGGCGGCCCC | 5806 | AGGuGGuGGcGGcGGccccdTsdT | sense |
| 281-300 | 5807 | GGGGCCGCCGCCACCACCU | 5808 | GGGGCCGCCGCCACcACCUdTsdT | antis |
| 282-301 | 5809 | GGUGGUGGCGGCGGCCCCG | 5810 | GGuGGuGGcGGcGGccccGdTsdT | sense |
| 282-301 | 5811 | CGGGGCCGCCGCCACCACC | 5812 | CGGGGCCGCCGCcACcACCdTsdT | antis |
| 283-302 | 5813 | GUGGUGGCGGCGGCCCCGG | 5814 | GuGGuGGcGGcGGccccGGdTsdT | sense |
| 283-302 | 5815 | CCGGGGCCGCCGCCACCAC | 5816 | CCGGGGCCGCCGCcAccACdTsdT | antis |
| 289-308 | 5817 | GCGGCGCCCCGGGGCUC | 5818 | GcGGcGGccccGGGGGcucdTsdT | sense |
| 289-308 | 5819 | GAGCCCCCGGGGCCGCCGC | 5820 | GAGCCCCCGGGGCCGCCGCdTsdT | antis |
| 291-310 | 5821 | GGCGGCCCCGGGGCUCGG | 5822 | GGcGGccccGGGGGcucGGdTsdT | sense |
| 291-310 | 5823 | CCGAGCCCCCGGGGCCGCC | 5824 | CCGAGCCCCCGGGGCCGCCdTsdT | antis |
| 296-315 | 5825 | CCCCGGGGGCUCGGCCUCU | 5826 | ccccGGGGGcucGGccucudTsdT | sense |
| 296-315 | 5827 | AGAGGCCGAGCCCCCGGGG | 5828 | AGAGGCCGAGCCCCCGGGGdTsdT | antis |
| 303-322 | 5829 | GGCUCGGCCUCUGGCCCAG | 5830 | GGcucGGccucuGGcccAGdTsdT | sense |
| 303-322 | 5831 | CUGGGCCAGAGGCCGAGCC | 5832 | CUGGGCcAGAGGCCGAGCCdTsdT | antis |
| 320-339 | 5833 | AGGAGGCACUGGCGGCGGG | 5834 | AGGAGGcAcuGGcGGcGGGdTsdT | sense |
| 320-339 | 5835 | CCCGCCGCCAGUGCCUCCU | 5836 | CCCGCCGCcAGUGCCUCCUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 382-401 | 5837 | GCUCCGGGGUGGCCCCAG | 5838 | GcuccGGGGGuGGccccAGdTsdT | sense |
| 382-401 | 5839 | CUGGGGCCACCCCCGGAGC | 5840 | CUGGGGCcACCCCCGGAGCdTsdT | antis |
| 383-402 | 5841 | CUCCGGGGUGGCCCAGC | 5842 | cuccGGGGGuGGcccAGdTsdT | sense |
| 383-402 | 5843 | GCUGGGGCCACCCCCGGAG | 5844 | GCUGGGGCcACCCCCGGAGdTsdT | antis |
| 395-414 | 5845 | CCCCAGCGGCAGCGGCGGA | 5846 | ccccAGcGGcAGcGGcGGAdTsdT | sense |
| 395-414 | 5847 | UCCGCCGCUGCCGCUGGGG | 5848 | UCCGCCGCUGCCGCUGGGGdTsdT | antis |
| 396-415 | 5849 | CCCAGCGGCAGCGGCGGAG | 5850 | cccAGcGGcAGcGGcGGAGdTsdT | sense |
| 396-415 | 5851 | CUCCGCCGCUGCCGCUGGG | 5852 | CUCCGCCGCUGCCGCUGGGdTsdT | antis |
| 397-416 | 5853 | CCAGCGGCAGCGGCGGAGG | 5854 | ccAGcGGcAGcGGcGGAGGdTsdT | sense |
| 397-416 | 5855 | CCUCCGCCGCUGCCGCUGG | 5856 | CCUCCGCCGCUGCCGCUGGdTsdT | antis |
| 398-417 | 5857 | CAGCGGCAGCGGCGGAGGA | 5858 | cAGcGGcAGcGGcGGAGGAdTsdT | sense |
| 398-417 | 5859 | UCCUCCGCCGCUGCCGCUG | 5860 | UCCUCCGCCGCUGCCGCUGdTsdT | antis |
| 400-419 | 5861 | GCGGCAGCGGCGGAGGAGG | 5862 | GcGGcAGcGGcGGAGGAGGdTsdT | sense |
| 400-419 | 5863 | CCUCCUCCGCCGCUGCCGC | 5864 | CCUCCUCCGCCGCUGCCGCdTsdT | antis |
| 405-424 | 5865 | AGCGGCGGAGGAGGCAGCG | 5866 | AGcGGcGGAGGAGGcAGcGdTsdT | sense |
| 405-424 | 5867 | CGCUGCCUCCUCCGCCGCU | 5868 | CGCUGCCUCCUCCGCCGCUdTsdT | antis |
| 406-425 | 5869 | GCGGCGGAGGAGGCAGCGG | 5870 | GcGGcGGAGGAGGcAGcGGdTsdT | sense |
| 406-425 | 5871 | CCGCUGCCUCCUCCGCCGC | 5872 | CCGCUGCCUCCUCCGCCGCdTsdT | antis |
| 407-426 | 5873 | CGGCGGAGGAGGCAGCGGU | 5874 | cGGcGGAGGAGGcAGcGGudTsdT | sense |
| 407-426 | 5875 | ACCGCUGCCUCCUCCGCCG | 5876 | ACCGCUGCCUCCUCCGCCGdTsdT | antis |
| 408-427 | 5877 | GGCGGAGGAGGCAGCGGUG | 5878 | GGcGGAGGAGGcAGcGGuGdTsdT | sense |
| 408-427 | 5879 | CACCGCUGCCUCCUCCGCC | 5880 | cACCGCUGCCUCCUCCGCCdTsdT | antis |
| 444-463 | 5881 | AGCUUCCCGCCGCCGGGAG | 5882 | AGcuucccGccGccGGGAGdTsdT | sense |
| 444-463 | 5883 | CUCCCGGCGGCGGGAAGCU | 5884 | CUCCCGGCGGCGGGAAGCUdTsdT | antis |
| 461-480 | 5885 | AGUGAAGCUGGGCCGUGAC | 5886 | AGuGAAGcuGGGccGuGAcdTsdT | sense |
| 461-480 | 5887 | GUCACGGCCCAGCUUCACU | 5888 | GUcACGGCCCAGCUUcACUdTsdT | antis |
| 493-512 | 5889 | CCACAGUGGUAGCCACUGU | 5890 | ccAcAGuGGuAGccAcuGudTsdT | sense |
| 493-512 | 5891 | ACAGUGGCUACCACUGUGG | 5892 | AcAGUGGcuAccACUGUGGdTsdT | antis |
| 513-532 | 5893 | GGCCAAGGCCCAGAGCGUU | 5894 | GGccAAGGcccAGAGcGuudTsdT | sense |
| 513-532 | 5895 | AACGCUCUGGGCCUUGGCC | 5896 | AACGCUCUGGGCCUUGGCCdTsdT | antis |
| 606-625 | 5897 | GCAGAGACGAGGGAACUGG | 5898 | GcAGAGAcGAGGGAAcuGGdTsdT | sense |
| 606-625 | 5899 | CCAGUUCCCUCGUCUCUGC | 5900 | CcAGUUCCCUCGUCUCUGCdTsdT | antis |
| 616-635 | 5901 | GGGAACUGGUGGCCAUCAA | 5902 | GGGAAcuGGuGGccAucAAdTsdT | sense |
| 616-635 | 5903 | UUGAUGGCCACCAGUUCCC | 5904 | UUGAUGGCcACcAGUUCCCdTsdT | antis |
| 620-639 | 5905 | ACUGGUGGCCAUCAAGAAG | 5906 | AcuGGuGGccAucAAGAAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 620-639 | 5907 | CUUCUUGAUGGCCACCAGU | 5908 | CUUCUUGAUGGCcACcAGUdTsdT | antis |
| 621-640 | 5909 | CUGGUGGCCAUCAAGAAGG | 5910 | cuGGuGGccAucAAGAAGGdTsdT | sense |
| 621-640 | 5911 | CCUUCUUGAUGGCCACCAG | 5912 | CCUUCUUGAUGGCcACcAGdTsdT | antis |
| 711-730 | 5913 | AGGCUGCGGUACUUUUUCU | 5914 | AGGcuGcGGuAcuuuuucudTsdT | sense |
| 711-730 | 5915 | AGAAAAAGUACCGCAGCCU | 5916 | AGAAAAAGuACCGcAGCCUdTsdT | antis |
| 712-731 | 5917 | GGCUGCGGUACUUUUUCUA | 5918 | GGcuGcGGuAcuuuuucuAdTsdT | sense |
| 712-731 | 5919 | UAGAAAAAGUACCGCAGCC | 5920 | uAGAAAAAGuACCGcAGCCdTsdT | antis |
| 716-735 | 5921 | GCGGUACUUUUUCUACUCC | 5922 | GcGGuAcuuuuucuAcuccdTsdT | sense |
| 716-735 | 5923 | GGAGUAGAAAAAGUACCGC | 5924 | GGAGuAGAAAAAGuACCGCdTsdT | antis |
| 851-870 | 5925 | CAUCAAGGUGUACAUGUAC | 5926 | cAucAAGGuGuAcAuGuAcdTsdT | sense |
| 851-870 | 5927 | GUACAUGUACACCUUGAUG | 5928 | GuAcAUGuAcACCUUGAUGdTsdT | antis |
| 891-910 | 5929 | UACAUCCACUCCCAAGGUG | 5930 | uAcAuccAcucccAAGGuGdTsdT | sense |
| 891-910 | 5931 | CACCUUGGGAGUGGAUGUA | 5932 | cACCUUGGGAGUGGAUGuAdTsdT | antis |
| 948-967 | 5933 | GACCCUGACACUGCUGUCC | 5934 | GAcccuGAcAcuGcuGuccdTsdT | sense |
| 948-967 | 5935 | GGACAGCAGUGUCAGGGUC | 5936 | GGAcAGcAGUGUcAGGGUCdTsdT | antis |
| 951-970 | 5937 | CCUGACACUGCUGUCCUCA | 5938 | ccuGAcAcuGcuGuccucAdTsdT | sense |
| 951-970 | 5939 | UGAGGACAGCAGUGUCAGG | 5940 | UGAGGAcAGcAGUGUcAGGdTsdT | antis |
| 955-974 | 5941 | ACACUGCUGUCCUCAAGCU | 5942 | AcAcuGcuGuccucAAGcudTsdT | sense |
| 955-974 | 5943 | AGCUUGAGGACAGCAGUGU | 5944 | AGCUUGAGGAcAGcAGUGUdTsdT | antis |
| 956-975 | 5945 | CACUGCUGUCCUCAAGCUC | 5946 | cAcuGcuGuccucAAGcucdTsdT | sense |
| 956-975 | 5947 | GAGCUUGAGGACAGCAGUG | 5948 | GAGCUUGAGGAcAGcAGUGdTsdT | antis |
| 958-977 | 5949 | CUGCUGUCCUCAAGCUCUG | 5950 | cuGcuGuccucAAGcucuGdTsdT | sense |
| 958-977 | 5951 | CAGAGCUUGAGGACAGCAG | 5952 | cAGAGCUUGAGGAcAGcAGdTsdT | antis |
| 959-978 | 5953 | UGCUGUCCUCAAGCUCUGC | 5954 | uGcuGuccucAAGcucuGcdTsdT | sense |
| 959-978 | 5955 | GCAGAGCUUGAGGACAGCA | 5956 | GcAGAGCUUGAGGAcAGcAdTsdT | antis |
| 1028-1047 | 5957 | CAUCUGCUCUCGGUACUAC | 5958 | cAucuGcucucGGuAcuAcdTsdT | sense |
| 1028-1047 | 5959 | GUAGUACCGAGAGCAGAUG | 5960 | GuAGuACCGAGAGcAGAUGdTsdT | antis |
| 1052-1071 | 5961 | UCCAGAACUCAUCUUUGGA | 5962 | uccAGAAcucAucuuuGGAdTsdT | sense |
| 1052-1071 | 5963 | UCCAAAGAUGAGUUCUGGA | 5964 | UCcAAAGAUGAGUUCUGGAdTsdT | antis |
| 1084-1103 | 5965 | CCUCGUCCAUCGAUGUGUG | 5966 | ccucGuccAucGAuGuGuGdTsdT | sense |
| 1084-1103 | 5967 | CACACAUCGAUGGACGAGG | 5968 | cAcAcAUCGAUGGACGAGGdTsdT | antis |
| 1103-1122 | 5969 | GUCGGCUGGCUGUGUACUU | 5970 | GucGGcuGGcuGuGuAcuudTsdT | sense |
| 1103-1122 | 5971 | AAGUACACAGCCAGCCGAC | 5972 | AAGuAcAcAGCcAGCCGACdTsdT | antis |
| 1111-1130 | 5973 | GCUGUGUACUUGCUGAGCU | 5974 | GcuGuGuAcuuGcuGAGcudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1111-1130 | 5975 | AGCUCAGCAAGUACACAGC | 5976 | AGCUcAGcAAGuAcAcAGCdTsdT | antis |
| 1116-1135 | 5977 | GUACUUGCUGAGCUACUUC | 5978 | GuAcuuGcuGAGcuAcuucdTsdT | sense |
| 1116-1135 | 5979 | GAAGUAGCUCAGCAAGUAC | 5980 | GAAGuAGCUcAGcAAGuACdTsdT | antis |
| 1132-1151 | 5981 | UUCUCGGCCAGCCCAUCUU | 5982 | uucucGGccAGcccAucuudTsdT | sense |
| 1132-1151 | 5983 | AAGAUGGGCUGGCCGAGAA | 5984 | AAGAUGGGCUGGCCGAGAAdTsdT | antis |
| 1133-1152 | 5985 | UCUCGGCCAGCCCAUCUUC | 5986 | ucucGGccAGcccAucuucdTsdT | sense |
| 1133-1152 | 5987 | GAAGAUGGGCUGGCCGAGA | 5988 | GAAGAUGGGCUGGCCGAGAdTsdT | antis |
| 1136-1155 | 5989 | CGGCCAGCCCAUCUUCCCU | 5990 | cGGccAGcccAucuucccudTsdT | sense |
| 1136-1155 | 5991 | AGGGAAGAUGGGCUGGCCG | 5992 | AGGGAAGAUGGGCUGGCCGdTsdT | antis |
| 1143-1162 | 5993 | CCCAUCUUCCCUGGGGACA | 5994 | cccAucuucccuGGGGAcAdTsdT | sense |
| 1143-1162 | 5995 | UGUCCCAGGGAAGAUGGG | 5996 | UGUCCCcAGGGAAGAUGGGdTsdT | antis |
| 1147-1166 | 5997 | UCUUCCCUGGGGACAGUGG | 5998 | ucuucccuGGGGAcAGuGGdTsdT | sense |
| 1147-1166 | 5999 | CCACUGUCCCCAGGGAAGA | 6000 | CcACUGUCCCcAGGGAAGAdTsdT | antis |
| 1152-1171 | 6001 | CCUGGGGACAGUGGGGUGG | 6002 | ccuGGGGAcAGuGGGGuGGdTsdT | sense |
| 1152-1171 | 6003 | CCACCCCACUGUCCCCAGG | 6004 | CcACCCcACUGUCCCcAGGdTsdT | antis |
| 1161-1180 | 6005 | AGUGGGGUGGACCAGCUUG | 6006 | AGuGGGGuGGAccAGcuuGdTsdT | sense |
| 1161-1180 | 6007 | CAAGCUGGUCCACCCCACU | 6008 | cAAGCUGGUCcACCCcACUdTsdT | antis |
| 1277-1296 | 6009 | CCCUUGGACAAAGGUGUUC | 6010 | cccuuGGAcAAAGGuGuucdTsdT | sense |
| 1277-1296 | 6011 | GAACACCUUUGUCCAAGGG | 6012 | GAAcACCUUUGUCcAAGGGdTsdT | antis |
| 1298-1317 | 6013 | AUCUUCAAAGACACCACCU | 6014 | AucuucAAAGAcAccAccudTsdT | sense |
| 1298-1317 | 6015 | AGGUGGUGUCUUUGAAGAU | 6016 | AGGUGGUGUCUUUGAAGAUdTsdT | antis |
| 1300-1319 | 6017 | CUUCAAAGACACCACCGA | 6018 | cuucAAAGAcAccAccuGAdTsdT | sense |
| 1300-1319 | 6019 | UCAGGUGGUGUCUUUGAAG | 6020 | UcAGGUGGUGUCUUUGAAGdTsdT | antis |
| 1301-1320 | 6021 | UUCAAAGACACCACCUGAG | 6022 | uucAAAGAcAccAccuGAGdTsdT | sense |
| 1301-1320 | 6023 | CUCAGGUGGUGUCUUUGAA | 6024 | CUcAGGUGGUGUCUUUGAAdTsdT | antis |
| 1357-1376 | 6025 | CAUCCUCAAGGCUCUCCCC | 6026 | cAuccucAAGGcucuccccdTsdT | sense |
| 1357-1376 | 6027 | GGGGAGAGCCUUGAGGAUG | 6028 | GGGGAGAGCCUUGAGGAUGdTsdT | antis |
| 1390-1409 | 6029 | CCCACAGCUUCUUCGAUGA | 6030 | cccAcAGcuucuucGAuGAdTsdT | sense |
| 1390-1409 | 6031 | UCAUCGAAGAAGCUGUGGG | 6032 | UcAUCGAAGAAGCUGUGGGdTsdT | antis |
| 1419-1438 | 6033 | CUCGGAGCCCAGCUCCCCA | 6034 | cucGGAGcccAGcuccccAdTsdT | sense |
| 1419-1438 | 6035 | UGGGGAGCUGGGCUCCGAG | 6036 | UGGGGAGCUGGGCUCCGAGdTsdT | antis |
| 1421-1440 | 6037 | CGGAGCCCAGCUCCCCAAC | 6038 | cGGAGcccAGcuccccAAcdTsdT | sense |
| 1421-1440 | 6039 | GUUGGGGAGCUGGGCUCCG | 6040 | GUUGGGGAGCUGGGCUCCGdTsdT | antis |
| 1497-1516 | 6041 | UCUCUCAAUGCCAUUCUCA | 6042 | ucucucAAuGccAuucucAdTsdT | sense |
| 1497-1516 | 6043 | UGAGAAUGGCAUUGAGAGA | 6044 | UGAGAAUGGcAUUGAGAGAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1500-1519 | 6045 | CUCAAUGCCAUUCUCAUCC | 6046 | cucAAuGccAuucucAuccdTsdT | sense |
| 1500-1519 | 6047 | GGAUGAGAAUGGCAUUGAG | 6048 | GGAUGAGAAUGGcAUUGAGdTsdT | antis |
| 1501-1520 | 6049 | UCAAUGCCAUUCUCAUCCC | 6050 | ucAAuGccAuucucAucccdTsdT | sense |
| 1501-1520 | 6051 | GGGAUGAGAAUGGCAUUGA | 6052 | GGGAUGAGAAUGGcAUUGAdTsdT | antis |
| 1540-1559 | 6053 | CAGGCCCUGCUUCUCCCCU | 6054 | cAGGcccuGcuucuccccudTsdT | sense |
| 1540-1559 | 6055 | AGGGGAGAAGCAGGGCCUG | 6056 | AGGGGAGAAGcAGGGCCUGdTsdT | antis |
| 1547-1566 | 6057 | UGCUUCUCCCCUCACCACU | 6058 | uGcuucuccccucAccAcudTsdT | sense |
| 1547-1566 | 6059 | AGUGGUGAGGGGAGAAGCA | 6060 | AGUGGUGAGGGGAGAAGcAdTsdT | antis |
| 1586-1605 | 6061 | AGCUUUAACUGAAGCUCAG | 6062 | AGcuuuAAcuGAAGcucAGdTsdT | sense |
| 1586-1605 | 6063 | CUGAGCUUCAGUUAAAGCU | 6064 | CUGAGCUUcAGUuAAAGCUdTsdT | antis |
| 1621-1640 | 6065 | AGCCAUCUGAUGCCACAAC | 6066 | AGccAucuGAuGccAcAAcdTsdT | sense |
| 1621-1640 | 6067 | GUUGUGGCAUCAGAUGGCU | 6068 | GUUGUGGcAUcAGAUGGCUdTsdT | antis |
| 1818-1837 | 6069 | AGCCUAACCUCUGUGGUGG | 6070 | AGccuAAccucuGuGGuGGdTsdT | sense |
| 1818-1837 | 6071 | CCACCACAGAGGUUAGGCU | 6072 | CcACcAcAGAGGUuAGGCUdTsdT | antis |
| 1865-1884 | 6073 | UAGGGGAGGGGAGAAAAGG | 6074 | uAGGGGAGGGGAGAAAAGGdTsdT | sense |
| 1865-1884 | 6075 | CCUUUUCUCCCCUCCCCUA | 6076 | CCUUUUCUCCCCUCCCCuAdTsdT | antis |
| 1866-1885 | 6077 | AGGGGAGGGGAGAAAAGGA | 6078 | AGGGGAGGGGAGAAAAGGAdTsdT | sense |
| 1866-1885 | 6079 | UCCUUUUCUCCCCUCCCCU | 6080 | UCCUUUUCUCCCCUCCCCUdTsdT | antis |
| 1867-1886 | 6081 | GGGGAGGGGAGAAAAGGAA | 6082 | GGGGAGGGGAGAAAAGGAAdTsdT | sense |
| 1867-1886 | 6083 | UUCCUUUUCUCCCCUCCCC | 6084 | UUCCUUUUCUCCCCUCCCCdTsdT | antis |
| 1868-1887 | 6085 | GGGAGGGGAGAAAAGGAAG | 6086 | GGGAGGGGAGAAAAGGAAGdTsdT | sense |
| 1868-1887 | 6087 | CUUCCUUUUCUCCCCUCCC | 6088 | CUUCCUUUUCUCCCCUCCCdTsdT | antis |
| 1872-1891 | 6089 | GGGGAGAAAAGGAAGGACG | 6090 | GGGGAGAAAAGGAAGGAcGdTsdT | sense |
| 1872-1891 | 6091 | CGUCCUUCCUUUUCUCCCC | 6092 | CGUCCUUCCUUUUCUCCCCdTsdT | antis |
| 1901-1920 | 6093 | GUGUGAGGACCUUCUACCC | 6094 | GuGuGAGGAccuucuAcccdTsdT | sense |
| 1901-1920 | 6095 | GGGUAGAAGGUCCUCACAC | 6096 | GGGuAGAAGGUCCUcAcACdTsdT | antis |
| 1929-1948 | 6097 | CCUCCCCUCCCCCAGGCUA | 6098 | ccucccucccccAGGcuAdTsdT | sense |
| 1929-1948 | 6099 | UAGCCUGGGGGAGGGGAGG | 6100 | uAGCCUGGGGGAGGGGAGGdTsdT | antis |
| 1930-1949 | 6101 | CUCCCCUCCCCCAGGCUAC | 6102 | cuccccucccccAGGcuAcdTsdT | sense |
| 1930-1949 | 6103 | GUAGCCUGGGGGAGGGGAG | 6104 | GuAGCCUGGGGGAGGGGAGdTsdT | antis |
| 1947-1966 | 6105 | ACCACUCCUUCCCUCCCCC | 6106 | AccAcuccuucccuccccdTsdT | sense |
| 1947-1966 | 6107 | GGGGGAGGGAAGGAGUGGU | 6108 | GGGGGAGGGAAGGAGUGGUdTsdT | antis |
| 1948-1967 | 6109 | CCACUCCUUCCCUCCCCCC | 6110 | ccAcuccuucccucccccdTsdT | sense |
| 1948-1967 | 6111 | GGGGGGAGGGAAGGAGUGG | 6112 | GGGGGGAGGGAAGGAGUGGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1949-1968 | 6113 | CACUCCUUCCCUCCCCCCC | 6114 | cAcuccuucccuccccccdTsdT | sense |
| 1949-1968 | 6115 | GGGGGGGAGGGAAGGAGUG | 6116 | GGGGGGGAGGGAAGGAGUGdTsdT | antis |
| 1950-1969 | 6117 | ACUCCUUCCCUCCCCCCU | 6118 | AcuccuucccuccccccudTsdT | sense |
| 1950-1969 | 6119 | AGGGGGGGAGGGAAGGAGU | 6120 | AGGGGGGGAGGGAAGGAGUdTsdT | antis |
| 1951-1970 | 6121 | CUCCUUCCCUCCCCCCUC | 6122 | cuccuucccuccccccucdTsdT | sense |
| 1951-1970 | 6123 | GAGGGGGGGAGGGAAGGAG | 6124 | GAGGGGGGGAGGGAAGGAGdTsdT | antis |
| 1955-1974 | 6125 | UUCCCUCCCCCCCUCUCCC | 6126 | uucccuccccccucucccdTsdT | sense |
| 1955-1974 | 6127 | GGGAGAGGGGGGGAGGGAA | 6128 | GGGAGAGGGGGGGAGGGAAdTsdT | antis |
| 1956-1975 | 6129 | UCCCUCCCCCCCUCUCCCA | 6130 | ucccuccccccucucccAdTsdT | sense |
| 1956-1975 | 6131 | UGGGAGAGGGGGGGAGGGA | 6132 | UGGGAGAGGGGGGGAGGGAdTsdT | antis |
| 1965-1984 | 6133 | CCCUCUCCCAGGUCCCUUG | 6134 | cccucucccAGGucccuuGdTsdT | sense |
| 1965-1984 | 6135 | CAAGGGACCUGGGAGAGGG | 6136 | cAAGGGACCUGGGAGAGGGdTsdT | antis |
| 1971-1990 | 6137 | CCCAGGUCCCUUGUAAAUA | 6138 | cccAGGucccuuGuAAAuAdTsdT | sense |
| 1971-1990 | 6139 | UAUUUACAAGGGACCUGGG | 6140 | uAUUuAcAAGGGACCUGGGdTsdT | antis |
| 1988-2007 | 6141 | UAGAACCAGCCCAGCCCAU | 6142 | uAGAAccAGcccAGcccAudTsdT | sense |
| 1988-2007 | 6143 | AUGGGCUGGGCUGGUUCUA | 6144 | AUGGGCUGGGCUGGUUCuAdTsdT | antis |
| 2005-2024 | 6145 | AUCUCUCGUCUUCCCUUCC | 6146 | AucucucGucuucccuuccdTsdT | sense |
| 2005-2024 | 6147 | GGAAGGGAAGACGAGAGAU | 6148 | GGAAGGGAAGACGAGAGAUdTsdT | antis |
| 2006-2025 | 6149 | UCUCUCGUCUUCCCUUCCC | 6150 | ucucucGucuucccuucccdTsdT | sense |
| 2006-2025 | 6151 | GGGAAGGGAAGACGAGAGA | 6152 | GGGAAGGGAAGACGAGAGAdTsdT | antis |
| 2020-2039 | 6153 | UUCCCUGGCCCCCUGGGUG | 6154 | uucccuGGccccuGGGuGdTsdT | sense |
| 2020-2039 | 6155 | CACCCAGGGGGCCAGGGAA | 6156 | cACCcAGGGGGCcAGGGAAdTsdT | antis |
| 2039-2058 | 6157 | UAAAUAGAUUGUUAUAAUU | 6158 | uAAAuAGAuuGuuAuAAuudTsdT | sense |
| 2039-2058 | 6159 | AAUUAUAACAAUCUAUUUA | 6160 | AAUuAuAAcAAUCuAUUuAdTsdT | antis |
| 2050-2069 | 6161 | UUAUAAUUUUUUCUUAAAG | 6162 | uuAuAAuuuuuucuuAAAGdTsdT | sense |
| 2050-2069 | 6163 | CUUUAAGAAAAAAUUAUAA | 6164 | CUUuAAGAAAAAAUuAuAAdTsdT | antis |
| 2052-2071 | 6165 | AUAAUUUUUUCUUAAAGAA | 6166 | AuAAuuuuuucuuAAAGAAdTsdT | sense |
| 2052-2071 | 6167 | UUCUUUAAGAAAAAAUUAU | 6168 | UUCUUuAAGAAAAAAUuAUdTsdT | antis |
| 2053-2072 | 6169 | UAAUUUUUUCUUAAAGAAA | 6170 | uAAuuuuuucuuAAAGAAAdTsdT | sense |
| 2053-2072 | 6171 | UUUCUUUAAGAAAAAAUUA | 6172 | UUUCUUuAAGAAAAAAUuAdTsdT | antis |
| 2054-2073 | 6173 | AAUUUUUUCUUAAAGAAAA | 6174 | AAuuuuuucuuAAAGAAAAdTsdT | sense |
| 2054-2073 | 6175 | UUUUCUUUAAGAAAAAAUU | 6176 | UUUUCUUuAAGAAAAAAUUdTsdT | antis |
| 2110-2129 | 6177 | UACCCCUUCUUGUCCUCUG | 6178 | uAccccuucuuGuccucuGdTsdT | sense |
| 2110-2129 | 6179 | CAGAGGACAAGAAGGGGUA | 6180 | cAGAGGAcAAGAAGGGGuAdTsdT | antis |
| 2112-2131 | 6181 | CCCCUUCUUGUCCUCUGCU | 6182 | ccccuucuuGuccucuGcudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2112-2131 | 6183 | AGCAGAGGACAAGAAGGGG | 6184 | AGcAGAGGAcAAGAAGGGGdTsdT | antis |
| 2113-2132 | 6185 | CCCUUCUUGUCCUCUGCUC | 6186 | cccuucuuGuccucuGcucdTsdT | sense |
| 2113-2132 | 6187 | GAGCAGAGGACAAGAAGGG | 6188 | GAGcAGAGGAcAAGAAGGGdTsdT | antis |
| 2114-2133 | 6189 | CCUUCUUGUCCUCUGCUCC | 6190 | ccuucuuGuccucuGcuccdTsdT | sense |
| 2114-2133 | 6191 | GGAGCAGAGGACAAGAAGG | 6192 | GGAGcAGAGGAcAAGAAGGdTsdT | antis |
| 2115-2134 | 6193 | CUUCUUGUCCUCUGCUCCC | 6194 | cuucuuGuccucuGcuccdTsdT | sense |
| 2115-2134 | 6195 | GGGAGCAGAGGACAAGAAG | 6196 | GGGAGcAGAGGAcAAGAAGdTsdT | antis |
| 2126-2145 | 6197 | CUGCUCCCAAGGCUUCCUC | 6198 | cuGcucccAAGGcuuccucdTsdT | sense |
| 2126-2145 | 6199 | GAGGAAGCCUUGGGAGCAG | 6200 | GAGGAAGCCUUGGGAGcAGdTsdT | antis |
| 2131-2150 | 6201 | CCCAAGGCUUCCUCCCUCU | 6202 | cccAAGGcuuccucccucudTsdT | sense |
| 2131-2150 | 6203 | AGAGGGAGGAAGCCUUGGG | 6204 | AGAGGGAGGAAGCCUUGGGdTsdT | antis |
| 2137-2156 | 6205 | GCUUCCUCCCUCUCCCCAU | 6206 | GcuuccucccucucccAudTsdT | sense |
| 2137-2156 | 6207 | AUGGGGAGAGGGAGGAAGC | 6208 | AUGGGGAGAGGGAGGAAGCdTsdT | antis |
| 2138-2157 | 6209 | CUUCCUCCCUCUCCCCAUC | 6210 | cuuccucccucuccccAucdTsdT | sense |
| 2138-2157 | 6211 | GAUGGGGAGAGGGAGGAAG | 6212 | GAUGGGGAGAGGGAGGAAGdTsdT | antis |
| 2140-2159 | 6213 | UCCUCCCUCUCCCCAUCCU | 6214 | uccucccucuccccAuccudTsdT | sense |
| 2140-2159 | 6215 | AGGAUGGGGAGAGGGAGGA | 6216 | AGGAUGGGGAGAGGGAGGAdTsdT | antis |
| 2141-2160 | 6217 | CCUCCCUCUCCCCAUCCUG | 6218 | ccucccucuccccAuccuGdTsdT | sense |
| 2141-2160 | 6219 | CAGGAUGGGGAGAGGGAGG | 6220 | cAGGAUGGGGAGAGGGAGGdTsdT | antis |
| 2145-2164 | 6221 | CCUCUCCCCAUCCUGGAAG | 6222 | ccucuccccAuccuGGAAGdTsdT | sense |
| 2145-2164 | 6223 | CUUCCAGGAUGGGGAGAGG | 6224 | CUUCcAGGAUGGGGAGAGGdTsdT | antis |
| 2153-2172 | 6225 | CAUCCUGGAAGGAGGGGAG | 6226 | cAuccuGGAAGGAGGGGAGdTsdT | sense |
| 2153-2172 | 6227 | CUCCCCUCCUUCCAGGAUG | 6228 | CUCCCCUCCUUCcAGGAUGdTsdT | antis |
| 2172-2191 | 6229 | UAGAGAGAGUCCCUGGUGU | 6230 | uAGAGAGAGucccuGGuGudTsdT | sense |
| 2172-2191 | 6231 | ACACCAGGGACUCUCUCUA | 6232 | AcAccAGGGACUCUCUCuAdTsdT | antis |
| 2186-2205 | 6233 | GGUGUCUUAGUUUCCACAG | 6234 | GGuGucuuAGuuuccAcAGdTsdT | sense |
| 2186-2205 | 6235 | CUGUGGAAACUAAGACACC | 6236 | CUGUGGAAAcuAAGAcACCdTsdT | antis |
| 2193-2212 | 6237 | UAGUUUCCACAGUAAGGUU | 6238 | uAGuuuccAcAGuAAGGuudTsdT | sense |
| 2193-2212 | 6239 | AACCUUACUGUGGAAACUA | 6240 | AACCUuACUGUGGAAACuAdTsdT | antis |
| 2240-2259 | 6241 | AUUAUUGGCAUGAAACCCU | 6242 | AuuAuuGGcAuGAAAcccudTsdT | sense |
| 2240-2259 | 6243 | AGGGUUUCAUGCCAAUAAU | 6244 | AGGGUUUcAUGCcAAuAAUdTsdT | antis |
| 62-81 | 6245 | CUGGGCCGGAGCCGGAGCC | 6246 | cuGGGccGGAGccGGAGccdTsdT | sense |
| 62-81 | 6247 | GGCUCCGGCUCCGGCCCAG | 6248 | GGCUCCGGCUCCGGCCCAGdTsdT | antis |
| 120-139 | 6249 | GCGGCGGCAGAGGCAGCGG | 6250 | GcGGcGGcAGAGGcAGcGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 120-139 | 6251 | CCGCUGCCUCUGCCGCCGC | 6252 | CCGCUGCCUCUGCCGCCGCdTsdT | antis |
| 121-140 | 6253 | CGGCGGCAGAGGCAGCGGC | 6254 | cGGcGGcAGAGGcAGcGGCdTsdT | sense |
| 121-140 | 6255 | GCCGCUGCCUCUGCCGCCG | 6256 | GCCGCUGCCUCUGCCGCCGdTsdT | antis |
| 127-146 | 6257 | CAGAGGCAGCGGCGGGGGC | 6258 | cAGAGGcAGcGGcGGGGGCdTsdT | sense |
| 127-146 | 6259 | GCCCCCGCCGCUGCCUCUG | 6260 | GCCCCCGCCGCUGCCUCUGdTsdT | antis |
| 142-161 | 6261 | GGGCAGCCCAGGCAGCCCG | 6262 | GGGcAGcccAGGcAGcccGdTsdT | sense |
| 142-161 | 6263 | CGGGCUGCCUGGGCUGCCC | 6264 | CGGGCUGCCUGGGCUGCCCdTsdT | antis |
| 267-286 | 6265 | GGAGGCGGAGGCGGAGGUG | 6266 | GGAGGcGGAGGcGGAGGuGdTsdT | sense |
| 267-286 | 6267 | CACCUCCGCCUCCGCCUCC | 6268 | cACCUCCGCCUCCGCCUCCdTsdT | antis |
| 268-287 | 6269 | GAGGCGGAGGCGGAGGUGG | 6270 | GAGGcGGAGGcGGAGGuGGdTsdT | sense |
| 268-287 | 6271 | CCACCUCCGCCUCCGCCUC | 6272 | CcACCUCCGCCUCCGCCUCdTsdT | antis |
| 271-290 | 6273 | GCGGAGGCGGAGGUGGUGG | 6274 | GcGGAGGcGGAGGuGGuGGdTsdT | sense |
| 271-290 | 6275 | CCACCACCUCCGCCUCCGC | 6276 | CcACcACCUCCGCCUCCGCdTsdT | antis |
| 284-303 | 6277 | UGGUGGCGGCGGCCCCGGG | 6278 | uGGuGGcGGcGGccccGGGdTsdT | sense |
| 284-303 | 6279 | CCCGGGGCCGCCGCCACCA | 6280 | CCCGGGGCCGCCGCcACcAdTsdT | antis |
| 591-610 | 6281 | UACCAGGCACGGCUGGCAG | 6282 | uAccAGGcAcGGcuGGcAGdTsdT | sense |
| 591-610 | 6283 | CUGCCAGCCGUGCCUGGUA | 6284 | CUGCcAGCCGUGCCUGGuAdTsdT | antis |
| 1131-1150 | 6285 | CUUCUCGGCCAGCCCAUCU | 6286 | cuucucGGccAGcccAucudTsdT | sense |
| 1131-1150 | 6287 | AGAUGGGCUGGCCGAGAAG | 6288 | AGAUGGGCUGGCCGAGAAGdTsdT | antis |
| 1299-1318 | 6289 | UCUUCAAAGACACCACCUG | 6290 | ucuucAAAGAcAccAccuGdTsdT | sense |
| 1299-1318 | 6291 | CAGGUGGUGUCUUUGAAGA | 6292 | cAGGUGGUGUCUUUGAAGAdTsdT | antis |
| 1558-1577 | 6293 | UCACCACUUCCUACAACCC | 6294 | ucAccAcuuccuAcAAcccdTsdT | sense |
| 1558-1577 | 6295 | GGGUUGUAGGAAGUGGUGA | 6296 | GGGUUGuAGGAAGUGGUGAdTsdT | antis |
| 1927-1946 | 6297 | CCCCUCCCCUCCCCCAGGC | 6298 | ccccucccucccccAGGcdTsdT | sense |
| 1927-1946 | 6299 | GCCUGGGGGAGGGGAGGGG | 6300 | GCCUGGGGGAGGGGAGGGGdTsdT | antis |
| 1928-1947 | 6301 | CCCUCCCCUCCCCCAGGCU | 6302 | cccucccucccccAGGcudTsdT | sense |
| 1928-1947 | 6303 | AGCCUGGGGGAGGGGAGGG | 6304 | AGCCUGGGGGAGGGGAGGGdTsdT | antis |
| 2111-2130 | 6305 | ACCCCUUCUUGUCCUCUGC | 6306 | AccccuucuuGuccucuGcdTsdT | sense |
| 2111-2130 | 6307 | GCAGAGGACAAGAAGGGGU | 6308 | GcAGAGGAcAAGAAGGGGUdTsdT | antis |
| 2142-2161 | 6309 | CUCCCUCUCCCCAUCCUGG | 6310 | cucccucuccccAuccuGGdTsdT | sense |
| 2142-2161 | 6311 | CCAGGAUGGGGAGAGGGAG | 6312 | CcAGGAUGGGGAGAGGGAGdTsdT | antis |
| 2144-2163 | 6313 | CCCUCUCCCCAUCCUGGAA | 6314 | cccucuccccAuccuGGAAdTsdT | sense |
| 2144-2163 | 6315 | UUCCAGGAUGGGGAGAGGG | 6316 | UUCcAGGAUGGGGAGAGGGdTsdT | antis |
| 1671-1690 | 6317 | CACCGACUACCCCUCCACG | 6318 | cAccGAcuAccccuccAcGdTsdT | sense |
| 1671-1690 | 6319 | CGUGGAGGGGUAGUCGGUG | 6320 | CGUGGAGGGGuAGUCGGUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1673-1692 | 6321 | CCGACUACCCCUCCACGUC | 6322 | ccGAcuAccccuccAcGucdTsdT | sense |
| 1673-1692 | 6323 | GACGUGGAGGGGUAGUCGG | 6324 | GACGUGGAGGGGuAGUCGGdTsdT | antis |
| 1036-1055 | 6325 | CUCGGUACUACCGUGCUCC | 6326 | cucGGuAcuAccGuGcuccdTsdT | sense |
| 1036-1055 | 6327 | GGAGCACGGUAGUACCGAG | 6328 | GGAGcACGGuAGuACCGAGdTsdT | antis |
| 1035-1054 | 6329 | UCUCGGUACUACCGUGCUC | 6330 | ucucGGuAcuAccGuGcucdTsdT | sense |
| 1035-1054 | 6331 | GAGCACGGUAGUACCGAGA | 6332 | GAGcACGGuAGuACCGAGAdTsdT | antis |
| 1042-1061 | 6333 | ACUACCGUGCUCCAGAACU | 6334 | AcuAccGuGcuccAGAAcudTsdT | sense |
| 1042-1061 | 6335 | AGUUCUGGAGCACGGUAGU | 6336 | AGUUCUGGAGcACGGuAGUdTsdT | antis |
| 1674-1693 | 6337 | CGACUACCCCUCCACGUCC | 6338 | cGAcuAccccuccAcGuccdTsdT | sense |
| 1674-1693 | 6339 | GGACGUGGAGGGGUAGUCG | 6340 | GGACGUGGAGGGGuAGUCGdTsdT | antis |
| 1787-1806 | 6341 | AACUACCCCCAGCAUCUAG | 6342 | AAcuAccccCAGcAucuAGdTsdT | sense |
| 1787-1806 | 6343 | CUAGAUGCUGGGGGUAGUU | 6344 | CuAGAUGCUGGGGGuAGUUdTsdT | antis |
| 1034-1053 | 6345 | CUCUCGGUACUACCGUGCU | 6346 | cucucGGuAcuAccGuGcudTsdT | sense |
| 1034-1053 | 6347 | AGCACGGUAGUACCGAGAG | 6348 | AGcACGGuAGuACCGAGAGdTsdT | antis |
| 1202-1221 | 6349 | AACGCCAACCAGGGAACAA | 6350 | AAcGccAAccAGGGAAcAAdTsdT | sense |
| 1202-1221 | 6351 | UUGUUCCCUGGUUGGCGUU | 6352 | UUGUUCCCUGGUUGGCGUUdTsdT | antis |
| 776-795 | 6353 | GGAGUAUGUGCCCGAGACG | 6354 | GGAGuAuGuGcccGAGAcGdTsdT | sense |
| 776-795 | 6355 | CGUCUCGGGCACAUACUCC | 6356 | CGUCUCGGGcAcAuACUCCdTsdT | antis |
| 779-798 | 6357 | GUAUGUGCCCGAGACGGUG | 6358 | GuAuGuGcccGAGAcGGuGdTsdT | sense |
| 779-798 | 6359 | CACCGUCUCGGGCACAUAC | 6360 | cACCGUCUCGGGcAcAuACdTsdT | antis |
| 780-799 | 6361 | UAUGUGCCCGAGACGGUGU | 6362 | uAuGuGcccGAGAcGGuGudTsdT | sense |
| 780-799 | 6363 | ACACCGUCUCGGGCACAUA | 6364 | AcACCGUCUCGGGcAcAuAdTsdT | antis |
| 973-992 | 6365 | UCUGCGAUUUGGCAGUGC | 6366 | ucuGcGAuuuGGcAGuGcdTsdT | sense |
| 973-992 | 6367 | GCACUGCCAAAAUCGCAGA | 6368 | GcACUGCcAAAAUCGcAGAdTsdT | antis |
| 1038-1057 | 6369 | CGGUACUACCGUGCUCCAG | 6370 | cGGuAcuAccGuGcuccAGdTsdT | sense |
| 1038-1057 | 6371 | CUGGAGCACGGUAGUACCG | 6372 | CUGGAGcACGGuAGuACCGdTsdT | antis |
| 1041-1060 | 6373 | UACUACCGUGCUCCAGAAC | 6374 | uAcuAccGuGcuccAGAAcdTsdT | sense |
| 1041-1060 | 6375 | GUUCUGGAGCACGGUAGUA | 6376 | GUUCUGGAGcACGGuAGuAdTsdT | antis |
| 1043-1062 | 6377 | CUACCGUGCUCCAGAACUC | 6378 | cuAccGuGcuccAGAAcucdTsdT | sense |
| 1043-1062 | 6379 | GAGUUCUGGAGCACGGUAG | 6380 | GAGUUCUGGAGcACGGuAGdTsdT | antis |
| 1189-1208 | 6381 | UCAAGGUACUAGGAACGCC | 6382 | ucAAGGuAcuAGGAAcGccdTsdT | sense |
| 1189-1208 | 6383 | GGCGUUCCUAGUACCUUGA | 6384 | GGCGUUCCuAGuACCUUGAdTsdT | antis |
| 1190-1209 | 6385 | CAAGGUACUAGGAACGCCA | 6386 | cAAGGuAcuAGGAAcGccAdTsdT | sense |
| 1190-1209 | 6387 | UGGCGUUCCUAGUACCUUG | 6388 | UGGCGUUCCuAGuACCUUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1191-1210 | 6389 | AAGGUACUAGGAACGCCAA | 6390 | AAGGuAcuAGGAAcGccAAdTsdT | sense |
| 1191-1210 | 6391 | UUGGCGUUCCUAGUACCUU | 6392 | UUGGCGUUCCuAGuACCUUdTsdT | antis |
| 1192-1211 | 6393 | AGGUACUAGGAACGCCAAC | 6394 | AGGuAcuAGGAAcGccAAcdTsdT | sense |
| 1192-1211 | 6395 | GUUGGCGUUCCUAGUACCU | 6396 | GUUGGCGUUCCuAGuACCUdTsdT | antis |
| 1197-1216 | 6397 | CUAGGAACGCCAACCAGGG | 6398 | cuAGGAAcGccAAccAGGGdTsdT | sense |
| 1197-1216 | 6399 | CCCUGGUUGGCGUUCCUAG | 6400 | CCCUGGUUGGCGUUCCuAGdTsdT | antis |
| 1203-1222 | 6401 | ACGCCAACCAGGGAACAAA | 6402 | AcGccAAccAGGGAAcAAAdTsdT | sense |
| 1203-1222 | 6403 | UUUGUUCCCUGGUUGGCGU | 6404 | UUUGUUCCCUGGUUGGCGUdTsdT | antis |
| 1670-1689 | 6405 | CCACCGACUACCCCUCCAC | 6406 | ccAccGAcuAccccuccAcdTsdT | sense |
| 1670-1689 | 6407 | GUGGAGGGGUAGUCGGUGG | 6408 | GUGGAGGGGuAGUCGGUGGdTsdT | antis |
| 1672-1691 | 6409 | ACCGACUACCCCUCCACGU | 6410 | AccGAcuAccccuccAcGudTsdT | sense |
| 1672-1691 | 6411 | ACGUGGAGGGGUAGUCGGU | 6412 | ACGUGGAGGGGuAGUCGGUdTsdT | antis |
| 1780-1799 | 6413 | GUAAAUGAACUACCCCCAG | 6414 | GuAAAuGAAcuAccccCAGdTsdT | sense |
| 1780-1799 | 6415 | CUGGGGGUAGUUCAUUUAC | 6416 | CUGGGGGuAGUUcAUUuACdTsdT | antis |
| 1786-1805 | 6417 | GAACUACCCCCAGCAUCUA | 6418 | GAAcuAccccAGcAucuAdTsdT | sense |
| 1786-1805 | 6419 | UAGAUGCUGGGGGUAGUUC | 6420 | uAGAUGCUGGGGGuAGUUCdTsdT | antis |
| 352-371 | 6421 | GGGCUAUGGGUGGGGGCGU | 6422 | GGGcuAuGGGuGGGGGcGudTsdT | sense |
| 352-371 | 6423 | ACGCCCCCACCCAUAGCCC | 6424 | ACGCCCCcACCCAuAGCCCdTsdT | antis |
| 354-373 | 6425 | GCUAUGGGUGGGGGCGUGG | 6426 | GcuAuGGGuGGGGGcGuGGdTsdT | sense |
| 354-373 | 6427 | CCACGCCCCCACCCAUAGC | 6428 | CcACGCCCCcACCCAuAGCdTsdT | antis |
| 521-540 | 6429 | CCCAGAGCGUUCCCAAGAA | 6430 | cccAGAGcGuucccAAGAAdTsdT | sense |
| 521-540 | 6431 | UUCUUGGGAACGCUCUGGG | 6432 | UUCUUGGGAACGCUCUGGGdTsdT | antis |
| 523-542 | 6433 | CAGAGCGUUCCCAAGAAGU | 6434 | cAGAGcGuucccAAGAAGudTsdT | sense |
| 523-542 | 6435 | ACUUCUUGGGAACGCUCUG | 6436 | ACUUCUUGGGAACGCUCUGdTsdT | antis |
| 524-543 | 6437 | AGAGCGUUCCCAAGAAGUG | 6438 | AGAGcGuucccAAGAAGuGdTsdT | sense |
| 524-543 | 6439 | CACUUCUUGGGAACGCUCU | 6440 | cACUUCUUGGGAACGCUCUdTsdT | antis |
| 527-546 | 6441 | GCGUUCCCAAGAAGUGGCU | 6442 | GcGuucccAAGAAGuGGcudTsdT | sense |
| 527-546 | 6443 | AGCCACUUCUUGGGAACGC | 6444 | AGCcACUUCUUGGGAACGCdTsdT | antis |
| 550-569 | 6445 | CUGACAUCAAAGUGAUUGG | 6446 | cuGAcAucAAAGuGAuuGGdTsdT | sense |
| 550-569 | 6447 | CCAAUCACUUUGAUGUCAG | 6448 | CcAAUcACUUUGAUGUcAGdTsdT | antis |
| 568-587 | 6449 | GUAAUGGCUCAUUCGGAGU | 6450 | GuAAuGGcucAuucGGAGudTsdT | sense |
| 568-587 | 6451 | ACUCCGAAUGAGCCAUUAC | 6452 | ACUCCGAAUGAGCcAUuACdTsdT | antis |
| 569-588 | 6453 | UAAUGGCUCAUUCGGAGUA | 6454 | uAAuGGcucAuucGGAGuAdTsdT | sense |
| 569-588 | 6455 | UACUCCGAAUGAGCCAUUA | 6456 | uACUCCGAAUGAGCcAUuAdTsdT | antis |
| 570-589 | 6457 | AAUGGCUCAUUCGGAGUAG | 6458 | AAuGGcucAuucGGAGuAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 570-589 | 6459 | CUACUCCGAAUGAGCCAUU | 6460 | CuACUCCGAAUGAGCcAUUdTsdT | antis |
| 572-591 | 6461 | UGGCUCAUUCGGAGUAGUA | 6462 | uGGcucAuucGGAGuAGuAdTsdT | sense |
| 572-591 | 6463 | UACUACUCCGAAUGAGCCA | 6464 | uACuACUCCGAAUGAGCcAdTsdT | antis |
| 626-645 | 6465 | GGCCAUCAAGAAGGUUCUU | 6466 | GGccAucAAGAAGGuucuudTsdT | sense |
| 626-645 | 6467 | AAGAACCUUCUUGAUGGCC | 6468 | AAGAACCUUCUUGAUGGCCdTsdT | antis |
| 688-707 | 6469 | AGCUGGACCACUGCAAUAU | 6470 | AGcuGGAccAcuGcAAuAudTsdT | sense |
| 688-707 | 6471 | AUAUUGCAGUGGUCCAGCU | 6472 | AuAUUGcAGUGGUCcAGCUdTsdT | antis |
| 693-712 | 6473 | GACCACUGCAAUAUUGUGA | 6474 | GAccAcuGcAAuAuuGuGAdTsdT | sense |
| 693-712 | 6475 | UCACAAUAUUGCAGUGGUC | 6476 | UcAcAAuAUUGcAGUGGUCdTsdT | antis |
| 697-716 | 6477 | ACUGCAAUAUUGUGAGGCU | 6478 | AcuGcAAuAuuGuGAGGcudTsdT | sense |
| 697-716 | 6479 | AGCCUCACAAUAUUGCAGU | 6480 | AGCCUcAcAAuAUUGcAGUdTsdT | antis |
| 724-743 | 6481 | UUUUCUACUCCAGUGGGGA | 6482 | uuuucuAcuccAGuGGGGAdTsdT | sense |
| 724-743 | 6483 | UCCCCACUGGAGUAGAAAA | 6484 | UCCCcACUGGAGuAGAAAAdTsdT | antis |
| 725-744 | 6485 | UUUCUACUCCAGUGGGGAG | 6486 | uuucuAcuccAGuGGGGAGdTsdT | sense |
| 725-744 | 6487 | CUCCCCACUGGAGUAGAAA | 6488 | CUCCCcACUGGAGuAGAAAdTsdT | antis |
| 726-745 | 6489 | UUCUACUCCAGUGGGGAGA | 6490 | uucuAcuccAGuGGGGAGAdTsdT | sense |
| 726-745 | 6491 | UCUCCCCACUGGAGUAGAA | 6492 | UCUCCCcACUGGAGuAGAAdTsdT | antis |
| 727-746 | 6493 | UCUACUCCAGUGGGGAGAA | 6494 | ucuAcuccAGuGGGGAGAAdTsdT | sense |
| 727-746 | 6495 | UUCUCCCCACUGGAGUAGA | 6496 | UUCUCCCcACUGGAGuAGAdTsdT | antis |
| 757-776 | 6497 | UGUAUUUGAAUCUGGUGCU | 6498 | uGuAuuuGAAucuGGUGcudTsdT | sense |
| 757-776 | 6499 | AGCACCAGAUUCAAAUACA | 6500 | AGcACcAGAUUcAAAuAcAdTsdT | antis |
| 759-778 | 6501 | UAUUUGAAUCUGGUGCUGG | 6502 | uAuuuGAAucuGGuGcuGGdTsdT | sense |
| 759-778 | 6503 | CCAGCACCAGAUUCAAAUA | 6504 | CcAGcACcAGAUUcAAAuAdTsdT | antis |
| 760-779 | 6505 | AUUUGAAUCUGGUGCUGGA | 6506 | AuuuGAAucuGGuGcuGGAdTsdT | sense |
| 760-779 | 6507 | UCCAGCACCAGAUUCAAAU | 6508 | UCcAGcACcAGAUUcAAAUdTsdT | antis |
| 762-781 | 6509 | UUGAAUCUGGUGCUGGAGU | 6510 | uuGAAucuGGuGcuGGAGudTsdT | sense |
| 762-781 | 6511 | ACUCCAGCACCAGAUUCAA | 6512 | ACUCcAGcACcAGAUUcAAdTsdT | antis |
| 763-782 | 6513 | UGAAUCUGGUGCUGGAGUA | 6514 | uGAAucuGGuGcuGGAGuAdTsdT | sense |
| 763-782 | 6515 | UACUCCAGCACCAGAUUCA | 6516 | uACUCcAGcACcAGAUUcAdTsdT | antis |
| 775-794 | 6517 | UGGAGUAUGUGCCCGAGAC | 6518 | uGGAGuAuGuGcccGAGAcdTsdT | sense |
| 775-794 | 6519 | GUCUCGGGCACAUACUCCA | 6520 | GUCUCGGGcAcAuACUCcAdTsdT | antis |
| 778-797 | 6521 | AGUAUGUGCCCGAGACGGU | 6522 | AGuAuGuGcccGAGAcGGudTsdT | sense |
| 778-797 | 6523 | ACCGUCUCGGGCACAUACU | 6524 | ACCGUCUCGGGcAcAuACUdTsdT | antis |
| 854-873 | 6525 | CAAGGUGUACAUGUACCAG | 6526 | cAAGGuGuAcAuGuAccAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 854-873 | 6527 | CUGGUACAUGUACACCUUG | 6528 | CUGGuAcAUGuAcACCUUGdTsdT | antis |
| 855-874 | 6529 | AAGGUGUACAUGUACCAGC | 6530 | AAGGuGuAcAuGuAccAGcdTsdT | sense |
| 855-874 | 6531 | GCUGGUACAUGUACACCUU | 6532 | GCUGGuAcAUGuAcACCUUdTsdT | antis |
| 856-875 | 6533 | AGGUGUACAUGUACCAGCU | 6534 | AGGuGuAcAuGuAccAGcudTsdT | sense |
| 856-875 | 6535 | AGCUGGUACAUGUACACCU | 6536 | AGCUGGuAcAUGuAcACCUdTsdT | antis |
| 857-876 | 6537 | GGUGUACAUGUACCAGCUC | 6538 | GGuGuAcAuGuAccAGcucdTsdT | sense |
| 857-876 | 6539 | GAGCUGGUACAUGUACACC | 6540 | GAGCUGGuAcAUGuAcACCdTsdT | antis |
| 915-934 | 6541 | CACCGUGACAUCAAGCCCC | 6542 | cAccGuGAcAucAAGccccdTsdT | sense |
| 915-934 | 6543 | GGGGCUUGAUGUCACGGUG | 6544 | GGGGCUUGAUGUcACGGUGdTsdT | antis |
| 938-957 | 6545 | UUUGCUUGUGGACCCUGAC | 6546 | uuuGcuuGuGGAcccuGAcdTsdT | sense |
| 938-957 | 6547 | GUCAGGGUCCACAAGCAAA | 6548 | GUcAGGGUCcAcAAGcAAAdTsdT | antis |
| 945-964 | 6549 | GUGGACCCUGACACUGCUG | 6550 | GuGGAcccuGAcAcuGcuGdTsdT | sense |
| 945-964 | 6551 | CAGCAGUGUCAGGGUCCAC | 6552 | cAGcAGUGUcAGGGUCcACdTsdT | antis |
| 971-990 | 6553 | GCUCUGCGAUUUUGGCAGU | 6554 | GcucuGcGAuuuuGGcAGudTsdT | sense |
| 971-990 | 6555 | ACUGCCAAAAUCGCAGAGC | 6556 | ACUGCcAAAAUCGcAGAGCdTsdT | antis |
| 972-991 | 6557 | CUCUGCGAUUUUGGCAGUG | 6558 | cucuGcGAuuuuGGcAGuGdTsdT | sense |
| 972-991 | 6559 | CACUGCCAAAAUCGCAGAG | 6560 | cACUGCcAAAAUCGcAGAGdTsdT | antis |
| 975-994 | 6561 | UGCGAUUUUGGCAGUGCAA | 6562 | uGcGAuuuuGGcAGuGcAAdTsdT | sense |
| 975-994 | 6563 | UUGCACUGCCAAAAUCGCA | 6564 | UUGcACUGCcAAAAUCGcAdTsdT | antis |
| 979-998 | 6565 | AUUUUGGCAGUGCAAAGCA | 6566 | AuuuuGGcAGuGcAAAGcAdTsdT | sense |
| 979-998 | 6567 | UGCUUUGCACUGCCAAAAU | 6568 | UGCUUUGcACUGCcAAAAUdTsdT | antis |
| 1037-1056 | 6569 | UCGGUACUACCGUGCUCCA | 6570 | ucGGuAcuAccGuGcuccAdTsdT | sense |
| 1037-1056 | 6571 | UGGAGCACGGUAGUACCGA | 6572 | UGGAGcACGGuAGuACCGAdTsdT | antis |
| 1040-1059 | 6573 | GUACUACCGUGCUCCAGAA | 6574 | GuAcuAccGuGcuccAGAAdTsdT | sense |
| 1040-1059 | 6575 | UUCGGAGCACGGUAGUAC | 6576 | UUCGGAGcACGGuAGuACdTsdT | antis |
| 1169-1188 | 6577 | GGACCAGCUUGUGGAGAUC | 6578 | GGAccAGcuuGuGGAGAucdTsdT | sense |
| 1169-1188 | 6579 | GAUCUCCACAAGCUGGUCC | 6580 | GAUCUCcAcAAGCUGGUCCdTsdT | antis |
| 1174-1193 | 6581 | AGCUUGUGGAGAUCAUCAA | 6582 | AGcuuGuGGAGAucAucAAdTsdT | sense |
| 1174-1193 | 6583 | UUGAUGAUCUCCACAAGCU | 6584 | UUGAUGAUCUCcAcAAGCUdTsdT | antis |
| 1178-1197 | 6585 | UGUGGAGAUCAUCAAGGUA | 6586 | uGuGGAGAucAucAAGGuAdTsdT | sense |
| 1178-1197 | 6587 | UACCUUGAUGAUCUCCACA | 6588 | uACCUUGAUGAUCUCcAcAdTsdT | antis |
| 1183-1202 | 6589 | AGAUCAUCAAGGUACUAGG | 6590 | AGAucAucAAGGuAcuAGGdTsdT | sense |
| 1183-1202 | 6591 | CCUAGUACCUUGAUGAUCU | 6592 | CCuAGuACCUUGAUGAUCUdTsdT | antis |
| 1193-1212 | 6593 | GGUACUAGGAACGCCAACC | 6594 | GGuAcuAGGAAcGccAAccdTsdT | sense |
| 1193-1212 | 6595 | GGUUGGCGUUCCUAGUACC | 6596 | GGUUGGCGUUCCuAGuACCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1194-1213 | 6597 | GUACUAGGAACGCCAACCA | 6598 | GuAcuAGGAAcGccAAccAdTsdT | sense |
| 1194-1213 | 6599 | UGGUUGGCGUUCCUAGUAC | 6600 | UGGUUGGCGUUCCuAGuACdTsdT | antis |
| 1195-1214 | 6601 | UACUAGGAACGCCAACCAG | 6602 | uAcuAGGAAcGccAAccAGdTsdT | sense |
| 1195-1214 | 6603 | CUGGUUGGCGUUCCUAGUA | 6604 | CUGGUUGGCGUUCCuAGuAdTsdT | antis |
| 1198-1217 | 6605 | UAGGAACGCCAACCAGGGA | 6606 | uAGGAAcGccAAccAGGGAdTsdT | sense |
| 1198-1217 | 6607 | UCCCUGGUUGGCGUUCCUA | 6608 | UCCCUGGUUGGCGUUCCuAdTsdT | antis |
| 1199-1218 | 6609 | AGGAACGCCAACCAGGGAA | 6610 | AGGAAcGccAAccAGGGAAdTsdT | sense |
| 1199-1218 | 6611 | UUCCCUGGUUGGCGUUCCU | 6612 | UUCCCUGGUUGGCGUUCCUdTsdT | antis |
| 1200-1219 | 6613 | GGAACGCCAACCAGGGAAC | 6614 | GGAAcGccAAccAGGGAAcdTsdT | sense |
| 1200-1219 | 6615 | GUUCCCUGGUUGGCGUUCC | 6616 | GUUCCCUGGUUGGCGUUCCdTsdT | antis |
| 1201-1220 | 6617 | GAACGCCAACCAGGGAACA | 6618 | GAAcGccAAccAGGGAAcAdTsdT | sense |
| 1201-1220 | 6619 | UGUUCCCUGGUUGGCGUUC | 6620 | UGUUCCCUGGUUGGCGUUCdTsdT | antis |
| 1206-1225 | 6621 | CCAACCAGGGAACAAAUCC | 6622 | ccAAccAGGGAAcAAAuccdTsdT | sense |
| 1206-1225 | 6623 | GGAUUUGUUCCCUGGUUGG | 6624 | GGAUUUGUUCCCUGGUUGGdTsdT | antis |
| 1208-1227 | 6625 | AACCAGGGAACAAAUCCGA | 6626 | AAccAGGGAAcAAAuccGAdTsdT | sense |
| 1208-1227 | 6627 | UCGGAUUUGUUCCCUGGUU | 6628 | UCGGAUUUGUUCCCUGGUUdTsdT | antis |
| 1218-1237 | 6629 | CAAAUCCGAGAGAUGAACC | 6630 | cAAAuccGAGAGAuGAAccdTsdT | sense |
| 1218-1237 | 6631 | GGUUCAUCUCUCGGAUUUG | 6632 | GGUUcAUCUCUCGGAUUUGdTsdT | antis |
| 1220-1239 | 6633 | AAUCCGAGAGAUGAACCCU | 6634 | AAuccGAGAGAuGAAcccudTsdT | sense |
| 1220-1239 | 6635 | AGGGUUCAUCUCUCGGAUU | 6636 | AGGGUUcAUCUCUCGGAUUdTsdT | antis |
| 1221-1240 | 6637 | AUCCGAGAGAUGAACCCUA | 6638 | AuccGAGAGAuGAAcccuAdTsdT | sense |
| 1221-1240 | 6639 | UAGGGUUCAUCUCUCGGAU | 6640 | uAGGGUUcAUCUCUCGGAUdTsdT | antis |
| 1453-1472 | 6641 | CCCCCCUGUUCAACUUCAG | 6642 | ccccccuGuucAAcuucAGdTsdT | sense |
| 1453-1472 | 6643 | CUGAAGUUGAACAGGGGGG | 6644 | CUGAAGUUGAAcAGGGGGGdTsdT | antis |
| 1675-1694 | 6645 | GACUACCCCUCCACGUCCA | 6646 | GAcuAccccuccAcGuccAdTsdT | sense |
| 1675-1694 | 6647 | UGGACGUGGAGGGGUAGUC | 6648 | UGGACGUGGAGGGGuAGUCdTsdT | antis |
| 1676-1695 | 6649 | ACUACCCCUCCACGUCCAU | 6650 | AcuAccccuccAcGuccAudTsdT | sense |
| 1676-1695 | 6651 | AUGGACGUGGAGGGGUAGU | 6652 | AUGGACGUGGAGGGGuAGUdTsdT | antis |
| 1677-1696 | 6653 | CUACCCCUCCACGUCCAUC | 6654 | cuAccccuccAcGuccAucdTsdT | sense |
| 1677-1696 | 6655 | GAUGGACGUGGAGGGGUAG | 6656 | GAUGGACGUGGAGGGGuAGdTsdT | antis |
| 1703-1722 | 6657 | GCCCAAGUGGCGCUGGGAA | 6658 | GcccAAGuGGcGcuGGGAAdTsdT | sense |
| 1703-1722 | 6659 | UUCCCAGCGCCACUUGGGC | 6660 | UUCCcAGCGCcACUUGGGCdTsdT | antis |
| 1706-1725 | 6661 | CAAGUGGCGCUGGGAAGGG | 6662 | cAAGuGGcGcuGGGAAGGGdTsdT | sense |
| 1706-1725 | 6663 | CCCUUCCCAGCGCCACUUG | 6664 | CCCUUCCcAGCGCcACUUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1752-1771 | 6665 | GGCUGGGCCCCUAGACUAG | 6666 | GGcuGGGccccuAGAcuAGdTsdT | sense |
| 1752-1771 | 6667 | CUAGUCUAGGGGCCCAGCC | 6668 | CuAGUCuAGGGGCCcAGCCdTsdT | antis |
| 1755-1774 | 6669 | UGGGCCCCUAGACUAGAGG | 6670 | uGGGccccuAGAcuAGAGGdTsdT | sense |
| 1755-1774 | 6671 | CCUCUAGUCUAGGGGCCCA | 6672 | CCUCuAGUCuAGGGGCCcAdTsdT | antis |
| 1758-1777 | 6673 | GCCCCUAGACUAGAGGGCA | 6674 | GccccuAGAcuAGAGGGcAdTsdT | sense |
| 1758-1777 | 6675 | UGCCCUCUAGUCUAGGGGC | 6676 | UGCCCUCuAGUCuAGGGGCdTsdT | antis |
| 1761-1780 | 6677 | CCUAGACUAGAGGGCAGAG | 6678 | ccuAGAcuAGAGGGcAGAGdTsdT | sense |
| 1761-1780 | 6679 | CUCUGCCCUCUAGUCUAGG | 6680 | CUCUGCCCUCuAGUCuAGGdTsdT | antis |
| 1765-1784 | 6681 | GACUAGAGGGCAGAGGUAA | 6682 | GAcuAGAGGGcAGAGGuAAdTsdT | sense |
| 1765-1784 | 6683 | UUACCUCUGCCCUCUAGUC | 6684 | UuACCUCUGCCCUCuAGUCdTsdT | antis |
| 1777-1796 | 6685 | GAGGUAAAUGAACUACCCC | 6686 | GAGGuAAAuGAAcuAccccdTsdT | sense |
| 1777-1796 | 6687 | GGGGUAGUUCAUUUACCUC | 6688 | GGGGuAGUUcAUUuACCUCdTsdT | antis |
| 1778-1797 | 6689 | AGGUAAAUGAACUACCCCC | 6690 | AGGuAAAuGAAcuAcccccdTsdT | sense |
| 1778-1797 | 6691 | GGGGGUAGUUCAUUUACCU | 6692 | GGGGGuAGUUcAUUuACCUdTsdT | antis |
| 1779-1798 | 6693 | GGUAAAUGAACUACCCCCA | 6694 | GGuAAAuGAAcuAcccccAdTsdT | sense |
| 1779-1798 | 6695 | UGGGGGUAGUUCAUUUACC | 6696 | UGGGGGuAGUUcAUUuACCdTsdT | antis |
| 1781-1800 | 6697 | UAAAUGAACUACCCCCAGC | 6698 | uAAAuGAAcuAcccccAGCdTsdT | sense |
| 1781-1800 | 6699 | GCUGGGGGUAGUUCAUUUA | 6700 | GCUGGGGGuAGUUcAUUuAdTsdT | antis |
| 1792-1811 | 6701 | CCCCCAGCAUCUAGGCCUC | 6702 | cccccAGcAucuAGGccucdTsdT | sense |
| 1792-1811 | 6703 | GAGGCCUAGAUGCUGGGGG | 6704 | GAGGCCuAGAUGCUGGGGGdTsdT | antis |
| 1796-1815 | 6705 | CAGCAUCUAGGCCUCCCUC | 6706 | cAGcAucuAGGccucccucdTsdT | sense |
| 1796-1815 | 6707 | GAGGGAGGCCUAGAUGCUG | 6708 | GAGGGAGGCCuAGAUGCUGdTsdT | antis |
| 1885-1904 | 6709 | AGGACGGGGUUUGGGGGUG | 6710 | AGGAcGGGGuuuGGGGGuGdTsdT | sense |
| 1885-1904 | 6711 | CACCCCCAAACCCCGUCCU | 6712 | cACCCCcAAACCCCGUCCUdTsdT | antis |
| 522-541 | 6713 | CCAGAGCGUUCCCAAGAAG | 6714 | ccAGAGcGuucccAAGAAGdTsdT | sense |
| 522-541 | 6715 | CUUCUUGGGAACGCUCUGG | 6716 | CUUCUUGGGAACGCUCUGGdTsdT | antis |
| 526-545 | 6717 | AGCGUUCCCAAGAAGUGGC | 6718 | AGcGuucccAAGAAGuGGCdTsdT | sense |
| 526-545 | 6719 | GCCACUUCUUGGGAACGCU | 6720 | GCcACUUCUUGGGAACGCUdTsdT | antis |
| 700-719 | 6721 | GCAAUAUUGUGAGGCUGCG | 6722 | GcAAuAuuGuGAGGcuGcGdTsdT | sense |
| 700-719 | 6723 | CGCAGCCUCACAAUAUUGC | 6724 | CGcAGCCUcAcAAuAUUGCdTsdT | antis |
| 873-892 | 6725 | CUCUUCCGGAGCUUGGCCU | 6726 | cucuuccGGAGcuuGGccudTsdT | sense |
| 873-892 | 6727 | AGGCCAAGCUCCGGAAGAG | 6728 | AGGCcAAGCUCCGGAAGAGdTsdT | antis |
| 1256-1275 | 6729 | GUUCCCCCAGAUCAAAGCU | 6730 | GuuccccAGAucAAAGcudTsdT | sense |
| 1256-1275 | 6731 | AGCUUUGAUCUGGGGGAAC | 6732 | AGCUUUGAUCUGGGGGAACdTsdT | antis |
| 1317-1336 | 6733 | GAGGCCAUUGCACUCUGCU | 6734 | GAGGccAuuGcAcucuGcudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1317-1336 | 6735 | AGCAGAGUGCAAUGGCCUC | 6736 | AGcAGAGUGcAAUGGCCUCdTsdT | antis |
| 1512-1531 | 6737 | CUCAUCCCUCCUCACUUGA | 6738 | cucAucccuccucAcuuGAdTsdT | sense |
| 1512-1531 | 6739 | UCAAGUGAGGAGGGAUGAG | 6740 | UcAAGUGAGGAGGGAUGAGdTsdT | antis |
| 1764-1783 | 6741 | AGACUAGAGGGCAGAGGUA | 6742 | AGAcuAGAGGGcAGAGGuAdTsdT | sense |
| 1764-1783 | 6743 | UACCUCUGCCCUCUAGUCU | 6744 | uACCUCUGCCCUCuAGUCUdTsdT | antis |
| 236-255 | 6745 | CCGGGCGCGGACCAGCUCG | 6746 | ccGGGcGcGGAccAGcucGdTsdT | sense |
| 236-255 | 6747 | CGAGCUGGUCCGCGCCCGG | 6748 | CGAGCUGGUCCGCGCCCGGdTsdT | antis |
| 914-933 | 6749 | UCACCGUGACAUCAAGCCC | 6750 | ucAccGuGAcAucAAGcccdTsdT | sense |
| 914-933 | 6751 | GGGCUUGAUGUCACGGUGA | 6752 | GGGCUUGAUGUcACGGUGAdTsdT | antis |
| 234-253 | 6753 | GGCCGGGCGCGGACCAGCU | 6754 | GGccGGGcGcGGAccAGcudTsdT | sense |
| 234-253 | 6755 | AGCUGGUCCGCGCCCGGCC | 6756 | AGCUGGUCCGCGCCCGGCCdTsdT | antis |
| 520-539 | 6757 | GCCCAGAGCGUUCCCAAGA | 6758 | GcccAGAGcGuucccAAGAdTsdT | sense |
| 520-539 | 6759 | UCUUGGGAACGCUCUGGGC | 6760 | UCUUGGGAACGCUCUGGGCdTsdT | antis |
| 525-544 | 6761 | GAGCGUUCCCAAGAAGUGG | 6762 | GAGcGuucccAAGAAGuGGdTsdT | sense |
| 525-544 | 6763 | CCACUUCUUGGGAACGCUC | 6764 | CcACUUCUUGGGAACGCUCdTsdT | antis |
| 549-568 | 6765 | ACUGACAUCAAAGUGAUUG | 6766 | AcuGAcAucAAAGuGAuuGdTsdT | sense |
| 549-568 | 6767 | CAAUCACUUUGAUGUCAGU | 6768 | cAAUcACUUUGAUGUcAGUdTsdT | antis |
| 555-574 | 6769 | AUCAAAGUGAUUGGUAAUG | 6770 | AucAAAGuGAuuGGuAAuGdTsdT | sense |
| 555-574 | 6771 | CAUUACCAAUCACUUUGAU | 6772 | cAUuACcAAUcACUUUGAUdTsdT | antis |
| 558-577 | 6773 | AAAGUGAUUGGUAAUGGCU | 6774 | AAAGuGAuuGGuAAuGGcudTsdT | sense |
| 558-577 | 6775 | AGCCAUUACCAAUCACUUU | 6776 | AGCcAUuACcAAUcACUUUdTsdT | antis |
| 567-586 | 6777 | GGUAAUGGCUCAUUCGGAG | 6778 | GGuAAuGGcucAuucGGAGdTsdT | sense |
| 567-586 | 6779 | CUCCGAAUGAGCCAUUACC | 6780 | CUCCGAAUGAGCcAUuACCdTsdT | antis |
| 571-590 | 6781 | AUGGCUCAUUCGGAGUAGU | 6782 | AuGGcucAuucGGAGuAGudTsdT | sense |
| 571-590 | 6783 | ACUACUCCGAAUGAGCCAU | 6784 | ACuACUCCGAAUGAGCcAUdTsdT | antis |
| 685-704 | 6785 | GUAAGCUGGACCACUGCAA | 6786 | GuAAGcuGGAccAcuGcAAdTsdT | sense |
| 685-704 | 6787 | UUGCAGUGGUCCAGCUUAC | 6788 | UUGcAGUGGUCcAGCUuACdTsdT | antis |
| 764-783 | 6789 | GAAUCUGGUGCUGGAGUAU | 6790 | GAAucuGGuGcuGGAGuAudTsdT | sense |
| 764-783 | 6791 | AUACUCCAGCACCAGAUUC | 6792 | AuACUCcAGcACcAGAUUCdTsdT | antis |
| 777-796 | 6793 | GAGUAUGUGCCCGAGACGG | 6794 | GAGuAuGuGcccGAGAcGGdTsdT | sense |
| 777-796 | 6795 | CCGUCUCGGGCACAUACUC | 6796 | CCGUCUCGGGcAcAuACUCdTsdT | antis |
| 783-802 | 6797 | GUGCCCGAGACGGUGUACC | 6798 | GuGcccGAGAcGGuGuAccdTsdT | sense |
| 783-802 | 6799 | GGUACACCGUCUCGGGCAC | 6800 | GGuAcACCGUCUCGGGcACdTsdT | antis |
| 802-821 | 6801 | GAGUGGCCCGCCACUUCAC | 6802 | GAGuGGcccGccAcuucAcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 802-821 | 6803 | GUGAAGUGGCGGGCCACUC | 6804 | GUGAAGUGGCGGGCcACUCdTsdT | antis |
| 818-837 | 6805 | CACCAAGGCCAAGCUGAUC | 6806 | cAccAAGGccAAGcuGAucdTsdT | sense |
| 818-837 | 6807 | GAUCAGCUUGGCCUUGGUG | 6808 | GAUcAGCUUGGCCUUGGUGdTsdT | antis |
| 852-871 | 6809 | AUCAAGGUGUACAUGUACC | 6810 | AucAAGGuGuAcAuGuAccdTsdT | sense |
| 852-871 | 6811 | GGUACAUGUACACCUUGAU | 6812 | GGuAcAUGuAcACCUUGAUdTsdT | antis |
| 853-872 | 6813 | UCAAGGUGUACAUGUACCA | 6814 | ucAAGGuGuAcAuGuAccAdTsdT | sense |
| 853-872 | 6815 | UGGUACAUGUACACCUUGA | 6816 | UGGuAcAUGuAcACCUUGAdTsdT | antis |
| 937-956 | 6817 | AUUUGCUUGUGGACCCUGA | 6818 | AuuuGcuuGuGGAcccuGAdTsdT | sense |
| 937-956 | 6819 | UCAGGGUCCACAAGCAAAU | 6820 | UcAGGGUCcAcAAGcAAAUdTsdT | antis |
| 942-961 | 6821 | CUUGUGGACCCUGACACUG | 6822 | cuuGuGGAcccuGAcAcuGdTsdT | sense |
| 942-961 | 6823 | CAGUGUCAGGGUCCACAAG | 6824 | cAGUGUcAGGGUCcAcAAGdTsdT | antis |
| 967-986 | 6825 | UCAAGCUCUGCGAUUUUGG | 6826 | ucAAGcucuGcGAuuuuGGdTsdT | sense |
| 967-986 | 6827 | CCAAAAUCGCAGAGCUUGA | 6828 | CcAAAAUCGcAGAGCUUGAdTsdT | antis |
| 968-987 | 6829 | CAAGCUCUGCGAUUUUGGC | 6830 | cAAGcucuGcGAuuuuGGcdTsdT | sense |
| 968-987 | 6831 | GCCAAAAUCGCAGAGCUUG | 6832 | GCcAAAAUCGcAGAGCUUGdTsdT | antis |
| 976-995 | 6833 | GCGAUUUUGGCAGUGCAAA | 6834 | GcGAuuuuGGcAGuGcAAAdTsdT | sense |
| 976-995 | 6835 | UUUGCACUGCCAAAAUCGC | 6836 | UUUGcACUGCcAAAAUCGCdTsdT | antis |
| 984-1003 | 6837 | GGCAGUGCAAAGCAGCUGG | 6838 | GGcAGuGcAAAGcAGcuGGdTsdT | sense |
| 984-1003 | 6839 | CCAGCUGCUUUGCACUGCC | 6840 | CcAGCUGCUUUGcACUGCCdTsdT | antis |
| 1039-1058 | 6841 | GGUACUACCGUGCUCCAGA | 6842 | GGuAcuAccGuGcuccAGAdTsdT | sense |
| 1039-1058 | 6843 | UCUGGAGCACGGUAGUACC | 6844 | UCUGGAGcACGGuAGuACCdTsdT | antis |
| 1044-1063 | 6845 | UACCGUGCUCCAGAACUCA | 6846 | uAccGuGcuccAGAAcucAdTsdT | sense |
| 1044-1063 | 6847 | UGAGUUCUGGAGCACGGUA | 6848 | UGAGUUCUGGAGcACGGuAdTsdT | antis |
| 1185-1204 | 6849 | AUCAUCAAGGUACUAGGAA | 6850 | AucAucAAGGuAcuAGGAAdTsdT | sense |
| 1185-1204 | 6851 | UUCCUAGUACCUUGAUGAU | 6852 | UUCCuAGuACCUUGAUGAUdTsdT | antis |
| 1188-1207 | 6853 | AUCAAGGUACUAGGAACGC | 6854 | AucAAGGuAcuAGGAAcGcdTsdT | sense |
| 1188-1207 | 6855 | GCGUUCCUAGUACCUUGAU | 6856 | GCGUUCCuAGuACCUUGAUdTsdT | antis |
| 1196-1215 | 6857 | ACUAGGAACGCCAACCAGG | 6858 | AcuAGGAAcGccAAccAGGdTsdT | sense |
| 1196-1215 | 6859 | CCUGGUUGGCGUUCCUAGU | 6860 | CCUGGUUGGCGUUCCuAGUdTsdT | antis |
| 1204-1223 | 6861 | CGCCAACCAGGGAACAAAU | 6862 | cGccAAccAGGGAAcAAAudTsdT | sense |
| 1204-1223 | 6863 | AUUUGUUCCCUGGUUGGCG | 6864 | AUUUGUUCCCUGGUUGGCGdTsdT | antis |
| 1213-1232 | 6865 | GGGAACAAAUCCGAGAGAU | 6866 | GGGAAcAAAuccGAGAGAudTsdT | sense |
| 1213-1232 | 6867 | AUCUCUCGGAUUUGUUCCC | 6868 | AUCUCUCGGAUUUGUUCCCdTsdT | antis |
| 1215-1234 | 6869 | GAACAAAUCCGAGAGAUGA | 6870 | GAAcAAAuccGAGAGAuGAdTsdT | sense |
| 1215-1234 | 6871 | UCAUCUCUCGGAUUUGUUC | 6872 | UcAUCUCUCGGAUUUGUUCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1216-1235 | 6873 | AACAAAUCCGAGAGAUGAA | 6874 | AAcAAAuccGAGAGAuGAAdTsdT | sense |
| 1216-1235 | 6875 | UUCAUCUCUCGGAUUUGUU | 6876 | UUcAUCUCUCGGAUUUGUUdTsdT | antis |
| 1217-1236 | 6877 | ACAAAUCCGAGAGAUGAAC | 6878 | AcAAAuccGAGAGAuGAAcdTsdT | sense |
| 1217-1236 | 6879 | GUUCAUCUCUCGGAUUUGU | 6880 | GUUcAUCUCUCGGAUUUGUdTsdT | antis |
| 1429-1448 | 6881 | AGCUCCCCAACGACCGCCC | 6882 | AGcuccccAAcGAccGcccdTsdT | sense |
| 1429-1448 | 6883 | GGGCGGUCGUUGGGGAGCU | 6884 | GGGCGGUCGUUGGGGAGCUdTsdT | antis |
| 1430-1449 | 6885 | GCUCCCCAACGACCGCCCG | 6886 | GcuccccAAcGAccGcccGdTsdT | sense |
| 1430-1449 | 6887 | CGGGCGGUCGUUGGGGAGC | 6888 | CGGGCGGUCGUUGGGGAGCdTsdT | antis |
| 1580-1599 | 6889 | CUCACAAGCUUUAACUGAA | 6890 | cucAcAAGcuuuAAcuGAAdTsdT | sense |
| 1580-1599 | 6891 | UUCAGUUAAAGCUUGUGAG | 6892 | UUcAGUuAAAGCUUGUGAGdTsdT | antis |
| 1667-1686 | 6893 | GCCCCACCGACUACCCCUC | 6894 | GccccAccGAcuAccccucdTsdT | sense |
| 1667-1686 | 6895 | GAGGGGUAGUCGGUGGGGC | 6896 | GAGGGGuAGUCGGUGGGGCdTsdT | antis |
| 1669-1688 | 6897 | CCCACCGACUACCCCUCCA | 6898 | cccAccGAcuAccccuccAdTsdT | sense |
| 1669-1688 | 6899 | UGGAGGGGUAGUCGGUGGG | 6900 | UGGAGGGGuAGUCGGUGGGdTsdT | antis |
| 1682-1701 | 6901 | CCUCCACGUCCAUCUGGGA | 6902 | ccuccAcGuccAucuGGGAdTsdT | sense |
| 1682-1701 | 6903 | UCCCAGAUGGACGUGGAGG | 6904 | UCCcAGAUGGACGUGGAGGdTsdT | antis |
| 1685-1704 | 6905 | CCACGUCCAUCUGGGAAGG | 6906 | ccAcGuccAucuGGGAAGGdTsdT | sense |
| 1685-1704 | 6907 | CCUUCCCAGAUGGACGUGG | 6908 | CCUUCCcAGAUGGACGUGGdTsdT | antis |
| 1704-1723 | 6909 | CCCAAGUGGCGCUGGGAAG | 6910 | cccAAGuGGcGcuGGGAAGdTsdT | sense |
| 1704-1723 | 6911 | CUUCCCAGCGCCACUUGGG | 6912 | CUUCCcAGCGCcACUUGGGdTsdT | antis |
| 1705-1724 | 6913 | CCAAGUGGCGCUGGGAAGG | 6914 | ccAAGuGGcGcuGGGAAGGdTsdT | sense |
| 1705-1724 | 6915 | CCUUCCCAGCGCCACUUGG | 6916 | CCUUCCcAGCGCcACUUGGdTsdT | antis |
| 1730-1749 | 6917 | CAGCCCAUCAAGCUCCUGC | 6918 | cAGcccAucAAGcuccuGcdTsdT | sense |
| 1730-1749 | 6919 | GCAGGAGCUUGAUGGGCUG | 6920 | GcAGGAGCUUGAUGGGCUGdTsdT | antis |
| 1753-1772 | 6921 | GCUGGGCCCUAGACUAGA | 6922 | GcuGGGccccuAGAcuAGAdTsdT | sense |
| 1753-1772 | 6923 | UCUAGUCUAGGGGCCCAGC | 6924 | UCuAGUCuAGGGGCCcAGCdTsdT | antis |
| 1759-1778 | 6925 | CCCCUAGACUAGAGGGCAG | 6926 | ccccuAGAcuAGAGGGcAGdTsdT | sense |
| 1759-1778 | 6927 | CUGCCCUCUAGUCUAGGGG | 6928 | CUGCCCUCuAGUCuAGGGGdTsdT | antis |
| 1760-1779 | 6929 | CCCUAGACUAGAGGGCAGA | 6930 | cccuAGAcuAGAGGGcAGAdTsdT | sense |
| 1760-1779 | 6931 | UCUGCCCUCUAGUCUAGGG | 6932 | UCUGCCCUCuAGUCuAGGGdTsdT | antis |
| 1763-1782 | 6933 | UAGACUAGAGGGCAGAGGU | 6934 | uAGAcuAGAGGGcAGAGGudTsdT | sense |
| 1763-1782 | 6935 | ACCUCUGCCCUCUAGUCUA | 6936 | ACCUCUGCCCUCuAGUCuAdTsdT | antis |
| 1773-1792 | 6937 | GGCAGAGGUAAAUGAACUA | 6938 | GGcAGAGGuAAAuGAAcuAdTsdT | sense |
| 1773-1792 | 6939 | UAGUUCAUUUACCUCUGCC | 6940 | uAGUUcAUUuACCUCUGCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1774-1793 | 6941 | GCAGAGGUAAAUGAACUAC | 6942 | GcAGAGGuAAAuGAAcuAcdTsdT | sense |
| 1774-1793 | 6943 | GUAGUUCAUUUACCUCUGC | 6944 | GuAGUUcAUUuACCUCUGCdTsdT | antis |
| 1782-1801 | 6945 | AAAUGAACUACCCCCAGCA | 6946 | AAAuGAAcuAccccCAGcAdTsdT | sense |
| 1782-1801 | 6947 | UGCUGGGGGUAGUUCAUUU | 6948 | UGCUGGGGGuAGUUcAUUUdTsdT | antis |
| 1784-1803 | 6949 | AUGAACUACCCCCAGCAUC | 6950 | AuGAAcuAccccCAGcAucdTsdT | sense |
| 1784-1803 | 6951 | GAUGCUGGGGGUAGUUCAU | 6952 | GAUGCUGGGGGuAGUUcAUdTsdT | antis |
| 1785-1804 | 6953 | UGAACUACCCCCAGCAUCU | 6954 | uGAAcuAccccCAGcAucudTsdT | sense |
| 1785-1804 | 6955 | AGAUGCUGGGGGUAGUUCA | 6956 | AGAUGCUGGGGGuAGUUcAdTsdT | antis |
| 1790-1809 | 6957 | UACCCCCAGCAUCUAGGCC | 6958 | uAccccCAGcAucuAGGccdTsdT | sense |
| 1790-1809 | 6959 | GGCCUAGAUGCUGGGGGUA | 6960 | GGCCuAGAUGCUGGGGGuAdTsdT | antis |
| 1794-1813 | 6961 | CCCAGCAUCUAGGCCUCCC | 6962 | cccAGcAucuAGGccucccdTsdT | sense |
| 1794-1813 | 6963 | GGGAGGCCUAGAUGCUGGG | 6964 | GGGAGGCCuAGAUGCUGGGdTsdT | antis |
| 1795-1814 | 6965 | CCAGCAUCUAGGCCUCCCU | 6966 | ccAGcAucuAGGccucccudTsdT | sense |
| 1795-1814 | 6967 | AGGGAGGCCUAGAUGCUGG | 6968 | AGGGAGGCCuAGAUGCUGGdTsdT | antis |
| 1882-1901 | 6969 | GGAAGGACGGGGUUUGGGG | 6970 | GGAAGGAcGGGGuuuGGGGdTsdT | sense |
| 1882-1901 | 6971 | CCCCAAACCCCGUCCUUCC | 6972 | CCCcAAACCCCGUCCUUCCdTsdT | antis |
| 1883-1902 | 6973 | GAAGGACGGGGUUUGGGGG | 6974 | GAAGGAcGGGGuuuGGGGGdTsdT | sense |
| 1883-1902 | 6975 | CCCCCAAACCCCGUCCUUC | 6976 | CCCCcAAACCCCGUCCUUCdTsdT | antis |
| 1913-1932 | 6977 | UCUACCCCCUUGGUCCCCU | 6978 | ucuAccccuuGGuccccudTsdT | sense |
| 1913-1932 | 6979 | AGGGGACCAAGGGGGUAGA | 6980 | AGGGGACcAAGGGGGuAGAdTsdT | antis |
| 68-87 | 6981 | CGGAGCCGGAGCCCGAACG | 6982 | cGGAGccGGAGcccGAAcGdTsdT | sense |
| 68-87 | 6983 | CGUUCGGGCUCCGGCUCCG | 6984 | CGUUCGGGCUCCGGCUCCGdTsdT | antis |
| 117-136 | 6985 | GAGGCGGCGGCAGAGGCAG | 6986 | GAGGcGGcGGcAGAGGcAGdTsdT | sense |
| 117-136 | 6987 | CUGCCUCUGCCGCCGCCUC | 6988 | CUGCCUCUGCCGCCGCCUCdTsdT | antis |
| 188-207 | 6989 | CGCCAUGAGCGGCGGCGGG | 6990 | cGccAuGAGcGGcGGcGGGdTsdT | sense |
| 188-207 | 6991 | CCCGCCGCCGCUCAUGGCG | 6992 | CCCGCCGCCGCUcAUGGCGdTsdT | antis |
| 219-238 | 6993 | GGCCCUGGGGGCUCGGGCC | 6994 | GGcccuGGGGGcucGGGccdTsdT | sense |
| 219-238 | 6995 | GGCCCGAGCCCCCAGGGCC | 6996 | GGCCCGAGCCCCcAGGGCCdTsdT | antis |
| 220-239 | 6997 | GCCCUGGGGGCUCGGGCCG | 6998 | GcccuGGGGGcucGGGccGdTsdT | sense |
| 220-239 | 6999 | CGGCCCGAGCCCCCAGGGC | 7000 | CGGCCCGAGCCCCcAGGGCdTsdT | antis |
| 233-252 | 7001 | GGGCCGGGCGCGGACCAGC | 7002 | GGGccGGGcGcGGAccAGcdTsdT | sense |
| 233-252 | 7003 | GCUGGUCCGCGCCCGGCCC | 7004 | GCUGGUCCGCGCCCGGCCCdTsdT | antis |
| 237-256 | 7005 | CGGGCGCGGACCAGCUCGU | 7006 | cGGGcGcGGAccAGcucGudTsdT | sense |
| 237-256 | 7007 | ACGAGCUGGUCCGCGCCCG | 7008 | ACGAGCUGGUCCGCGCCCGdTsdT | antis |
| 308-327 | 7009 | GGCCUCUGGCCCAGGAGGC | 7010 | GGccucuGGcccAGGAGGcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 308-327 | 7011 | GCCUCCUGGGCCAGAGGCC | 7012 | GCCUCCUGGGCcAGAGGCCdTsdT | antis |
| 311-330 | 7013 | CUCUGGCCCAGGAGGCACU | 7014 | cucuGGcccAGGAGGcAcudTsdT | sense |
| 311-330 | 7015 | AGUGCCUCCUGGGCCAGAG | 7016 | AGUGCCUCCUGGGCcAGAGdTsdT | antis |
| 351-370 | 7017 | GGGGCUAUGGGUGGGGGCG | 7018 | GGGGcuAuGGGuGGGGGcGdTsdT | sense |
| 351-370 | 7019 | CGCCCCCACCCAUAGCCCC | 7020 | CGCCCCcACCcAuAGCCCCdTsdT | antis |
| 353-372 | 7021 | GGCUAUGGGUGGGGGCGUG | 7022 | GGcuAuGGGuGGGGGcGuGdTsdT | sense |
| 353-372 | 7023 | CACGCCCCCACCCAUAGCC | 7024 | cACGCCCCcACCcAuAGCCdTsdT | antis |
| 355-374 | 7025 | CUAUGGGUGGGGGCGUGGG | 7026 | cuAuGGGuGGGGGcGuGGGdTsdT | sense |
| 355-374 | 7027 | CCCACGCCCCCACCCAUAG | 7028 | CCcACGCCCCcACCcAuAGdTsdT | antis |
| 357-376 | 7029 | AUGGGUGGGGGCGUGGGAG | 7030 | AuGGGuGGGGGcGuGGGAGdTsdT | sense |
| 357-376 | 7031 | CUCCCACGCCCCCACCCAU | 7032 | CUCCcACGCCCCcACCcAUdTsdT | antis |
| 361-380 | 7033 | GUGGGGGCGUGGGAGCCUC | 7034 | GuGGGGGcGuGGGAGccucdTsdT | sense |
| 361-380 | 7035 | GAGGCUCCCACGCCCCCAC | 7036 | GAGGCUCCcACGCCCCcACdTsdT | antis |
| 363-382 | 7037 | GGGGGCGUGGGAGCCUCGA | 7038 | GGGGGcGuGGGAGccucGAdTsdT | sense |
| 363-382 | 7039 | UCGAGGCUCCCACGCCCCC | 7040 | UCGAGGCUCCcACGCCCCCdTsdT | antis |
| 364-383 | 7041 | GGGGCGUGGGAGCCUCGAG | 7042 | GGGGcGuGGGAGccucGAGdTsdT | sense |
| 364-383 | 7043 | CUCGAGGCUCCCACGCCCC | 7044 | CUCGAGGCUCCcACGCCCCdTsdT | antis |
| 365-384 | 7045 | GGGCGUGGGAGCCUCGAGC | 7046 | GGGcGuGGGAGccucGAGcdTsdT | sense |
| 365-384 | 7047 | GCUCGAGGCUCCCACGCCC | 7048 | GCUCGAGGCUCCcACGCCCdTsdT | antis |
| 366-385 | 7049 | GGCGUGGGAGCCUCGAGCU | 7050 | GGcGuGGGAGccucGAGcudTsdT | sense |
| 366-385 | 7051 | AGCUCGAGGCUCCCACGCC | 7052 | AGCUCGAGGCUCCcACGCCdTsdT | antis |
| 368-387 | 7053 | CGUGGGAGCCUCGAGCUCC | 7054 | cGuGGGAGccucGAGcuccdTsdT | sense |
| 368-387 | 7055 | GGAGCUCGAGGCUCCCACG | 7056 | GGAGCUCGAGGCUCCcACGdTsdT | antis |
| 485-504 | 7057 | GAAGGUGACCACAGUGGUA | 7058 | GAAGGuGAccAcAGuGGuAdTsdT | sense |
| 485-504 | 7059 | UACCACUGUGGUCACCUUC | 7060 | uAccACUGUGGUcACCUUCdTsdT | antis |
| 487-506 | 7061 | AGGUGACCACAGUGGUAGC | 7062 | AGGuGAccAcAGuGGuAGcdTsdT | sense |
| 487-506 | 7063 | GCUACCACUGUGGUCACCU | 7064 | GCuAccACUGUGGUcACCUdTsdT | antis |
| 488-507 | 7065 | GGUGACCACAGUGGUAGCC | 7066 | GGuGAccAcAGuGGuAGccdTsdT | sense |
| 488-507 | 7067 | GGCUACCACUGUGGUCACC | 7068 | GGCuAccACUGUGGUcACCdTsdT | antis |
| 547-566 | 7069 | ACACUGACAUCAAAGUGAU | 7070 | AcAcuGAcAucAAAGuGAudTsdT | sense |
| 547-566 | 7071 | AUCACUUUGAUGUCAGUGU | 7072 | AUcACUUUGAUGUcAGUGUdTsdT | antis |
| 548-567 | 7073 | CACUGACAUCAAAGUGAUU | 7074 | cAcuGAcAucAAAGuGAuudTsdT | sense |
| 548-567 | 7075 | AAUCACUUUGAUGUCAGUG | 7076 | AAUcACUUUGAUGUcAGUGdTsdT | antis |
| 551-570 | 7077 | UGACAUCAAAGUGAUUGGU | 7078 | uGAcAucAAAGuGAuuGGudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 551-570 | 7079 | ACCAAUCACUUUGAUGUCA | 7080 | ACcAAUcACUUUGAUGUcAdTsdT | antis |
| 552-571 | 7081 | GACAUCAAAGUGAUUGGUA | 7082 | GAcAucAAAGuGAuuGGuAdTsdT | sense |
| 552-571 | 7083 | UACCAAUCACUUUGAUGUC | 7084 | uACcAAUcACUUUGAUGUCdTsdT | antis |
| 553-572 | 7085 | ACAUCAAAGUGAUUGGUAA | 7086 | AcAucAAAGuGAuuGGuAAdTsdT | sense |
| 553-572 | 7087 | UUACCAAUCACUUUGAUGU | 7088 | UuACcAAUcACUUUGAUGUdTsdT | antis |
| 554-573 | 7089 | CAUCAAAGUGAUUGGUAAU | 7090 | cAucAAAGuGAuuGGuAAudTsdT | sense |
| 554-573 | 7091 | AUUACCAAUCACUUUGAUG | 7092 | AUuACcAAUcACUUUGAUGdTsdT | antis |
| 556-575 | 7093 | UCAAAGUGAUUGGUAAUGG | 7094 | ucAAAGuGAuuGGuAAuGGdTsdT | sense |
| 556-575 | 7095 | CCAUUACCAAUCACUUUGA | 7096 | CcAUuACcAAUcACUUUGAdTsdT | antis |
| 557-576 | 7097 | CAAAGUGAUUGGUAAUGGC | 7098 | cAAAGuGAuuGGuAAuGGcdTsdT | sense |
| 557-576 | 7099 | GCCAUUACCAAUCACUUUG | 7100 | GCcAUuACcAAUcACUUUGdTsdT | antis |
| 562-581 | 7101 | UGAUUGGUAAUGGCUCAUU | 7102 | uGAuuGGuAAuGGcucAuudTsdT | sense |
| 562-581 | 7103 | AAUGAGCCAUUACCAAUCA | 7104 | AAUGAGCcAUuACcAAUcAdTsdT | antis |
| 563-582 | 7105 | GAUUGGUAAUGGCUCAUUC | 7106 | GAuuGGuAAuGGcucAuucdTsdT | sense |
| 563-582 | 7107 | GAAUGAGCCAUUACCAAUC | 7108 | GAAUGAGCcAUuACcAAUCdTsdT | antis |
| 564-583 | 7109 | AUUGGUAAUGGCUCAUUCG | 7110 | AuuGGuAAuGGcucAuucGdTsdT | sense |
| 564-583 | 7111 | CGAAUGAGCCAUUACCAAU | 7112 | CGAAUGAGCcAUuACcAAUdTsdT | antis |
| 565-584 | 7113 | UUGGUAAUGGCUCAUUCGG | 7114 | uuGGuAAuGGcucAuucGGdTsdT | sense |
| 565-584 | 7115 | CCGAAUGAGCCAUUACCAA | 7116 | CCGAAUGAGCcAUuACcAAdTsdT | antis |
| 566-585 | 7117 | UGGUAAUGGCUCAUUCGGA | 7118 | uGGuAAuGGcucAuucGGAdTsdT | sense |
| 566-585 | 7119 | UCCGAAUGAGCCAUUACCA | 7120 | UCCGAAUGAGCcAUuACcAdTsdT | antis |
| 627-646 | 7121 | GCCAUCAAGAAGGUUCUUC | 7122 | GccAucAAGAAGGuucuucdTsdT | sense |
| 627-646 | 7123 | GAAGAACCUUCUUGAUGGC | 7124 | GAAGAACCUUCUUGAUGGCdTsdT | antis |
| 631-650 | 7125 | UCAAGAAGGUUCUUCAGGA | 7126 | ucAAGAAGGuucuucAGGAdTsdT | sense |
| 631-650 | 7127 | UCCUGAAGAACCUUCUUGA | 7128 | UCCUGAAGAACCUUCUUGAdTsdT | antis |
| 632-651 | 7129 | CAAGAAGGUUCUUCAGGAC | 7130 | cAAGAAGGuucuucAGGAcdTsdT | sense |
| 632-651 | 7131 | GUCCUGAAGAACCUUCUUG | 7132 | GUCCUGAAGAACCUUCUUGdTsdT | antis |
| 634-653 | 7133 | AGAAGGUUCUUCAGGACAA | 7134 | AGAAGGuucuucAGGAcAAdTsdT | sense |
| 634-653 | 7135 | UUGUCCUGAAGAACCUUCU | 7136 | UUGUCCUGAAGAACCUUCUdTsdT | antis |
| 635-654 | 7137 | GAAGGUUCUUCAGGACAAA | 7138 | GAAGGuucuucAGGAcAAAdTsdT | sense |
| 635-654 | 7139 | UUUGUCCUGAAGAACCUUC | 7140 | UUUGUCCUGAAGAACCUUCdTsdT | antis |
| 638-657 | 7141 | GGUUCUUCAGGACAAAAGG | 7142 | GGuucuucAGGAcAAAAGGdTsdT | sense |
| 638-657 | 7143 | CCUUUUGUCCUGAAGAACC | 7144 | CCUUUUGUCCUGAAGAACCdTsdT | antis |
| 639-658 | 7145 | GUUCUUCAGGACAAAAGGU | 7146 | GuucuucAGGAcAAAAGGudTsdT | sense |
| 639-658 | 7147 | ACCUUUUGUCCUGAAGAAC | 7148 | ACCUUUUGUCCUGAAGAACdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 640-659 | 7149 | UUCUUCAGGACAAAAGGUU | 7150 | uucuucAGGAcAAAAGGuudTsdT | sense |
| 640-659 | 7151 | AACCUUUUGUCCUGAAGAA | 7152 | AACCUUUUGUCCUGAAGAAdTsdT | antis |
| 641-660 | 7153 | UCUUCAGGACAAAAGGUUC | 7154 | ucuucAGGAcAAAAGGuucdTsdT | sense |
| 641-660 | 7155 | GAACCUUUUGUCCUGAAGA | 7156 | GAACCUUUUGUCCUGAAGAdTsdT | antis |
| 642-661 | 7157 | CUUCAGGACAAAAGGUUCA | 7158 | cuucAGGAcAAAAGGuucAdTsdT | sense |
| 642-661 | 7159 | UGAACCUUUUGUCCUGAAG | 7160 | UGAACCUUUUGUCCUGAAGdTsdT | antis |
| 643-662 | 7161 | UUCAGGACAAAAGGUUCAA | 7162 | uucAGGAcAAAAGGuucAAdTsdT | sense |
| 643-662 | 7163 | UUGAACCUUUUGUCCUGAA | 7164 | UUGAACCUUUUGUCCUGAAdTsdT | antis |
| 644-663 | 7165 | UCAGGACAAAAGGUUCAAG | 7166 | ucAGGAcAAAAGGuucAAGdTsdT | sense |
| 644-663 | 7167 | CUUGAACCUUUUGUCCUGA | 7168 | CUUGAACCUUUUGUCCUGAdTsdT | antis |
| 645-664 | 7169 | CAGGACAAAAGGUUCAAGA | 7170 | cAGGAcAAAAGGuucAAGAdTsdT | sense |
| 645-664 | 7171 | UCUUGAACCUUUUGUCCUG | 7172 | UCUUGAACCUUUUGUCCUGdTsdT | antis |
| 686-705 | 7173 | UAAGCUGGACCACUGCAAU | 7174 | uAAGcuGGAccAcuGcAAudTsdT | sense |
| 686-705 | 7175 | AUUGCAGUGGUCCAGCUUA | 7176 | AUUGcAGUGGUCcAGCUuAdTsdT | antis |
| 687-706 | 7177 | AAGCUGGACCACUGCAAUA | 7178 | AAGcuGGAccAcuGcAAuAdTsdT | sense |
| 687-706 | 7179 | UAUUGCAGUGGUCCAGCUU | 7180 | uAUUGcAGUGGUCcAGCUUdTsdT | antis |
| 689-708 | 7181 | GCUGGACCACUGCAAUAUU | 7182 | GcuGGAccAcuGcAAuAUudTsdT | sense |
| 689-708 | 7183 | AAUAUUGCAGUGGUCCAGC | 7184 | AAuAUUGcAGUGGUCcAGCdTsdT | antis |
| 690-709 | 7185 | CUGGACCACUGCAAUAUUG | 7186 | cuGGAccAcuGcAAuAUuGdTsdT | sense |
| 690-709 | 7187 | CAAUAUUGCAGUGGUCCAG | 7188 | cAAuAUUGcAGUGGUCcAGdTsdT | antis |
| 691-710 | 7189 | UGGACCACUGCAAUAUUGU | 7190 | uGGAccAcuGcAAuAUuGudTsdT | sense |
| 691-710 | 7191 | ACAAUAUUGCAGUGGUCCA | 7192 | AcAAuAUUGcAGUGGUCcAdTsdT | antis |
| 692-711 | 7193 | GGACCACUGCAAUAUUGUG | 7194 | GGAccAcuGcAAuAUuGuGdTsdT | sense |
| 692-711 | 7195 | CACAAUAUUGCAGUGGUCC | 7196 | cAcAAuAUUGcAGUGGUCCdTsdT | antis |
| 694-713 | 7197 | ACCACUGCAAUAUUGUGAG | 7198 | AccAcuGcAAuAUuGuGAGdTsdT | sense |
| 694-713 | 7199 | CUCACAAUAUUGCAGUGGU | 7200 | CUcAcAAuAUUGcAGUGGUdTsdT | antis |
| 696-715 | 7201 | CACUGCAAUAUUGUGAGGC | 7202 | cAcuGcAAuAUuGuGAGGcdTsdT | sense |
| 696-715 | 7203 | GCCUCACAAUAUUGCAGUG | 7204 | GCCUcAcAAuAUUGcAGUGdTsdT | antis |
| 698-717 | 7205 | CUGCAAUAUUGUGAGGCUG | 7206 | cuGcAAuAUuGuGAGGcuGdTsdT | sense |
| 698-717 | 7207 | CAGCCUCACAAUAUUGCAG | 7208 | cAGCCUcAcAAuAUUGcAGdTsdT | antis |
| 699-718 | 7209 | UGCAAUAUUGUGAGGCUGC | 7210 | uGcAAuAUuGuGAGGcuGcdTsdT | sense |
| 699-718 | 7211 | GCAGCCUCACAAUAUUGCA | 7212 | GcAGCCUcAcAAuAUUGcAdTsdT | antis |
| 718-737 | 7213 | GGUACUUUUCUACUCCAG | 7214 | GGuAcuuuucuAcuccAGdTsdT | sense |
| 718-737 | 7215 | CUGGAGUAGAAAAGUACC | 7216 | CUGGAGuAGAAAAGuACCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 720-739 | 7217 | UACUUUUUCUACUCCAGUG | 7218 | uAcuuuuucuAcuccAGuGdTsdT | sense |
| 720-739 | 7219 | CACUGGAGUAGAAAAAGUA | 7220 | cACUGGAGuAGAAAAAGuAdTsdT | antis |
| 721-740 | 7221 | ACUUUUUCUACUCCAGUGG | 7222 | AcuuuuucuAcuccAGuGGdTsdT | sense |
| 721-740 | 7223 | CCACUGGAGUAGAAAAAGU | 7224 | CcACUGGAGuAGAAAAAGUdTsdT | antis |
| 723-742 | 7225 | UUUUUCUACUCCAGUGGGG | 7226 | uuuuucuAcuccAGuGGGGdTsdT | sense |
| 723-742 | 7227 | CCCCACUGGAGUAGAAAAA | 7228 | CCCcACUGGAGuAGAAAAAdTsdT | antis |
| 729-748 | 7229 | UACUCCAGUGGGGAGAAGA | 7230 | uAcuccAGuGGGGAGAAGAdTsdT | sense |
| 729-748 | 7231 | UCUUCUCCCCACUGGAGUA | 7232 | UCUUCUCCCcACUGGAGuAdTsdT | antis |
| 730-749 | 7233 | ACUCCAGUGGGGAGAAGAA | 7234 | AcuccAGuGGGGAGAAGAAdTsdT | sense |
| 730-749 | 7235 | UUCUUCUCCCCACUGGAGU | 7236 | UUCUUCUCCCcACUGGAGUdTsdT | antis |
| 736-755 | 7237 | GUGGGGAGAAGAAGGACGA | 7238 | GuGGGGAGAAGAAGGAcGAdTsdT | sense |
| 736-755 | 7239 | UCGUCCUUCUUCUCCCCAC | 7240 | UCGUCCUUCUUCUCCCcACdTsdT | antis |
| 737-756 | 7241 | UGGGGAGAAGAAGGACGAG | 7242 | uGGGGAGAAGAAGGAcGAGdTsdT | sense |
| 737-756 | 7243 | CUCGUCCUUCUUCUCCCCA | 7244 | CUCGUCCUUCUUCUCCCcAdTsdT | antis |
| 755-774 | 7245 | GCUGUAUUUGAAUCUGGUG | 7246 | GcuGuAuuuGAAucuGGuGdTsdT | sense |
| 755-774 | 7247 | CACCAGAUUCAAAUACAGC | 7248 | cAccAGAUUcAAAuAcAGCdTsdT | antis |
| 756-775 | 7249 | CUGUAUUUGAAUCUGGUGC | 7250 | cuGuAuuuGAAucuGGuGcdTsdT | sense |
| 756-775 | 7251 | GCACCAGAUUCAAAUACAG | 7252 | GcAccAGAUUcAAAuAcAGdTsdT | antis |
| 758-777 | 7253 | GUAUUUGAAUCUGGUGCUG | 7254 | GuAuuuGAAucuGGuGcuGdTsdT | sense |
| 758-777 | 7255 | CAGCACCAGAUUCAAAUAC | 7256 | cAGcAccAGAUUcAAAuACdTsdT | antis |
| 761-780 | 7257 | UUUGAAUCUGGUGCUGGAG | 7258 | uuuGAAucuGGuGcuGGAGdTsdT | sense |
| 761-780 | 7259 | CUCCAGCACCAGAUUCAAA | 7260 | CUCcAGcAccAGAUUcAAAdTsdT | antis |
| 765-784 | 7261 | AAUCUGGUGCUGGAGUAUG | 7262 | AAucuGGuGcuGGAGuAuGdTsdT | sense |
| 765-784 | 7263 | CAUACUCCAGCACCAGAUU | 7264 | cAuACUCcAGcAccAGAUUdTsdT | antis |
| 769-788 | 7265 | UGGUGCUGGAGUAUGUGCC | 7266 | uGGuGcuGGAGuAuGuGccdTsdT | sense |
| 769-788 | 7267 | GGCACAUACUCCAGCACCA | 7268 | GGcAcAuACUCcAGcACcAdTsdT | antis |
| 770-789 | 7269 | GGUGCUGGAGUAUGUGCCC | 7270 | GGuGcuGGAGuAuGuGcccdTsdT | sense |
| 770-789 | 7271 | GGGCACAUACUCCAGCACC | 7272 | GGGcAcAuACUCcAGcACCdTsdT | antis |
| 771-790 | 7273 | GUGCUGGAGUAUGUGCCCG | 7274 | GuGcuGGAGuAuGuGcccGdTsdT | sense |
| 771-790 | 7275 | CGGGCACAUACUCCAGCAC | 7276 | CGGGcAcAuACUCcAGcACdTsdT | antis |
| 772-791 | 7277 | UGCUGGAGUAUGUGCCCGA | 7278 | uGcuGGAGuAuGuGcccGAdTsdT | sense |
| 772-791 | 7279 | UCGGGCACAUACUCCAGCA | 7280 | UCGGGcAcAuACUCcAGcAdTsdT | antis |
| 773-792 | 7281 | GCUGGAGUAUGUGCCCGAG | 7282 | GcuGGAGuAuGuGcccGAGdTsdT | sense |
| 773-792 | 7283 | CUCGGGCACAUACUCCAGC | 7284 | CUCGGGcAcAuACUCcAGCdTsdT | antis |
| 774-793 | 7285 | CUGGAGUAUGUGCCCGAGA | 7286 | cuGGAGuAuGuGcccGAGAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 774-793 | 7287 | UCUCGGGCACAUACUCCAG | 7288 | UCUCGGGcAcAuACUCcAGdTsdT | antis |
| 781-800 | 7289 | AUGUGCCCGAGACGGUGUA | 7290 | AuGuGcccGAGAcGGuGuAdTsdT | sense |
| 781-800 | 7291 | UACACCGUCUCGGGCACAU | 7292 | uAcACCGUCUCGGGcAcAUdTsdT | antis |
| 782-801 | 7293 | UGUGCCCGAGACGGUGUAC | 7294 | uGuGcccGAGAcGGuGuAcdTsdT | sense |
| 782-801 | 7295 | GUACACCGUCUCGGGCACA | 7296 | GuAcACCGUCUCGGGcAcAdTsdT | antis |
| 803-822 | 7297 | AGUGGCCCGCCACUUCACC | 7298 | AGuGGcccGccAcuucAccdTsdT | sense |
| 803-822 | 7299 | GGUGAAGUGGCGGGCCACU | 7300 | GGUGAAGUGGCGGGCcACUdTsdT | antis |
| 804-823 | 7301 | GUGGCCCGCCACUUCACCA | 7302 | GuGGcccGccAcuucAccAdTsdT | sense |
| 804-823 | 7303 | UGGUGAAGUGGCGGGCCAC | 7304 | UGGUGAAGUGGCGGGCcACdTsdT | antis |
| 805-824 | 7305 | UGGCCCGCCACUUCACCAA | 7306 | uGGcccGccAcuucAccAAdTsdT | sense |
| 805-824 | 7307 | UUGGUGAAGUGGCGGGCCA | 7308 | UUGGUGAAGUGGCGGGCcAdTsdT | antis |
| 806-825 | 7309 | GGCCCGCCACUUCACCAAG | 7310 | GGcccGccAcuucAccAAGdTsdT | sense |
| 806-825 | 7311 | CUUGGUGAAGUGGCGGGCC | 7312 | CUUGGUGAAGUGGCGGGCCdTsdT | antis |
| 807-826 | 7313 | GCCCGCCACUUCACCAAGG | 7314 | GcccGccAcuucAccAAGGdTsdT | sense |
| 807-826 | 7315 | CCUUGGUGAAGUGGCGGGC | 7316 | CCUUGGUGAAGUGGCGGGCdTsdT | antis |
| 808-827 | 7317 | CCCGCCACUUCACCAAGGC | 7318 | cccGccAcuucAccAAGGCdTsdT | sense |
| 808-827 | 7319 | GCCUUGGUGAAGUGGCGGG | 7320 | GCCUUGGUGAAGUGGCGGGdTsdT | antis |
| 809-828 | 7321 | CCGCCACUUCACCAAGGCC | 7322 | ccGccAcuucAccAAGGccdTsdT | sense |
| 809-828 | 7323 | GGCCUUGGUGAAGUGGCGG | 7324 | GGCCUUGGUGAAGUGGCGGdTsdT | antis |
| 810-829 | 7325 | CGCCACUUCACCAAGGCCA | 7326 | cGccAcuucAccAAGGccAdTsdT | sense |
| 810-829 | 7327 | UGGCCUUGGUGAAGUGGCG | 7328 | UGGCCUUGGUGAAGUGGCGdTsdT | antis |
| 811-830 | 7329 | GCCACUUCACCAAGGCCAA | 7330 | GccAcuucAccAAGGccAAdTsdT | sense |
| 811-830 | 7331 | UUGGCCUUGGUGAAGUGGC | 7332 | UUGGCCUUGGUGAAGUGGCdTsdT | antis |
| 813-832 | 7333 | CACUUCACCAAGGCCAAGC | 7334 | cAcuucAccAAGGccAAGcdTsdT | sense |
| 813-832 | 7335 | GCUUGGCCUUGGUGAAGUG | 7336 | GCUUGGCCUUGGUGAAGUGdTsdT | antis |
| 815-834 | 7337 | CUUCACCAAGGCCAAGCUG | 7338 | cuucAccAAGGccAAGcuGdTsdT | sense |
| 815-834 | 7339 | CAGCUUGGCCUUGGUGAAG | 7340 | cAGCUUGGCCUUGGUGAAGdTsdT | antis |
| 817-836 | 7341 | UCACCAAGGCCAAGCUGAU | 7342 | ucAccAAGGccAAGcuGAudTsdT | sense |
| 817-836 | 7343 | AUCAGCUUGGCCUUGGUGA | 7344 | AUcAGCUUGGCCUUGGUGAdTsdT | antis |
| 858-877 | 7345 | GUGUACAUGUACCAGCUCU | 7346 | GuGuAcAuGuAccAGcucudTsdT | sense |
| 858-877 | 7347 | AGAGCUGGUACAUGUACAC | 7348 | AGAGCUGGuAcAUGuAcACdTsdT | antis |
| 860-879 | 7349 | GUACAUGUACCAGCUCUUC | 7350 | GuAcAuGuAccAGcucuucdTsdT | sense |
| 860-879 | 7351 | GAAGAGCUGGUACAUGUAC | 7352 | GAAGAGCUGGuAcAUGuACdTsdT | antis |
| 861-880 | 7353 | UACAUGUACCAGCUCUUCC | 7354 | uAcAuGuAccAGcucuuccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 861-880 | 7355 | GGAAGAGCUGGUACAUGUA | 7356 | GGAAGAGCUGGuAcAUGuAdTsdT | antis |
| 862-881 | 7357 | ACAUGUACCAGCUCUUCCG | 7358 | AcAuGuAccAGcucuuccGdTsdT | sense |
| 862-881 | 7359 | CGGAAGAGCUGGUACAUGU | 7360 | CGGAAGAGCUGGuAcAUGUdTsdT | antis |
| 863-882 | 7361 | CAUGUACCAGCUCUUCCGG | 7362 | cAuGuAccAGcucuuccGGdTsdT | sense |
| 863-882 | 7363 | CCGGAAGAGCUGGUACAUG | 7364 | CCGGAAGAGCUGGuAcAUGdTsdT | antis |
| 865-884 | 7365 | UGUACCAGCUCUUCCGGAG | 7366 | uGuAccAGcucuuccGGAGdTsdT | sense |
| 865-884 | 7367 | CUCCGGAAGAGCUGGUACA | 7368 | CUCCGGAAGAGCUGGuAcAdTsdT | antis |
| 866-885 | 7369 | GUACCAGCUCUUCCGGAGC | 7370 | GuAccAGcucuuccGGAGcdTsdT | sense |
| 866-885 | 7371 | GCUCCGGAAGAGCUGGUAC | 7372 | GCUCCGGAAGAGCUGGuACdTsdT | antis |
| 867-886 | 7373 | UACCAGCUCUUCCGGAGCU | 7374 | uAccAGcucuuccGGAGcudTsdT | sense |
| 867-886 | 7375 | AGCUCCGGAAGAGCUGGUA | 7376 | AGCUCCGGAAGAGCUGGuAdTsdT | antis |
| 868-887 | 7377 | ACCAGCUCUUCCGGAGCUU | 7378 | AccAGcucuuccGGAGcuudTsdT | sense |
| 868-887 | 7379 | AAGCUCCGGAAGAGCUGGU | 7380 | AAGCUCCGGAAGAGCUGGUdTsdT | antis |
| 869-888 | 7381 | CCAGCUCUUCCGGAGCUUG | 7382 | ccAGcucuuccGGAGcuuGdTsdT | sense |
| 869-888 | 7383 | CAAGCUCCGGAAGAGCUGG | 7384 | cAAGCUCCGGAAGAGCUGGdTsdT | antis |
| 870-889 | 7385 | CAGCUCUUCCGGAGCUUGG | 7386 | cAGcucuuccGGAGcuuGGdTsdT | sense |
| 870-889 | 7387 | CCAAGCUCCGGAAGAGCUG | 7388 | CcAAGCUCCGGAAGAGCUGdTsdT | antis |
| 871-890 | 7389 | AGCUCUUCCGGAGCUUGGC | 7390 | AGcucuuccGGAGcuuGGcdTsdT | sense |
| 871-890 | 7391 | GCCAAGCUCCGGAAGAGCU | 7392 | GCcAAGCUCCGGAAGAGCUdTsdT | antis |
| 872-891 | 7393 | GCUCUUCCGGAGCUUGGCC | 7394 | GcucuuccGGAGcuuGGccdTsdT | sense |
| 872-891 | 7395 | GGCCAAGCUCCGGAAGAGC | 7396 | GGCcAAGCUCCGGAAGAGCdTsdT | antis |
| 874-893 | 7397 | UCUUCCGGAGCUUGGCCUA | 7398 | ucuuccGGAGcuuGGccuAdTsdT | sense |
| 874-893 | 7399 | UAGGCCAAGCUCCGGAAGA | 7400 | uAGGCcAAGCUCCGGAAGAdTsdT | antis |
| 876-895 | 7401 | UUCCGGAGCUUGGCCUACA | 7402 | uuccGGAGcuuGGccuAcAdTsdT | sense |
| 876-895 | 7403 | UGUAGGCCAAGCUCCGGAA | 7404 | UGuAGGCcAAGCUCCGGAAdTsdT | antis |
| 877-896 | 7405 | UCCGGAGCUUGGCCUACAU | 7406 | uccGGAGcuuGGccuAcAudTsdT | sense |
| 877-896 | 7407 | AUGUAGGCCAAGCUCCGGA | 7408 | AUGuAGGCcAAGCUCCGGAdTsdT | antis |
| 878-897 | 7409 | CCGGAGCUUGGCCUACAUC | 7410 | ccGGAGcuuGGccuAcAucdTsdT | sense |
| 878-897 | 7411 | GAUGUAGGCCAAGCUCCGG | 7412 | GAUGuAGGCcAAGCUCCGGdTsdT | antis |
| 911-930 | 7413 | GUGUCACCGUGACAUCAAG | 7414 | GuGucAccGuGAcAucAAGdTsdT | sense |
| 911-930 | 7415 | CUUGAUGUCACGGUGACAC | 7416 | CUUGAUGUcACGGUGAcACdTsdT | antis |
| 935-954 | 7417 | GAAUUUGCUUGUGGACCCU | 7418 | GAAuuuGcuuGuGGAcccudTsdT | sense |
| 935-954 | 7419 | AGGGUCCACAAGCAAAUUC | 7420 | AGGGUCcAcAAGcAAAUUCdTsdT | antis |
| 939-958 | 7421 | UUGCUUGUGGACCCUGACA | 7422 | uuGcuuGuGGAcccuGAcAdTsdT | sense |
| 939-958 | 7423 | UGUCAGGGUCCACAAGCAA | 7424 | UGUcAGGGUCcAcAAGcAAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 940-959 | 7425 | UGCUUGUGGACCCUGACAC | 7426 | uGcuuGuGGAcccuGAcAcdTsdT | sense |
| 940-959 | 7427 | GUGUCAGGGUCCACAAGCA | 7428 | GUGUcAGGGUCcAcAAGcAdTsdT | antis |
| 941-960 | 7429 | GCUUGUGGACCCUGACACU | 7430 | GcuuGuGGAcccuGAcAcudTsdT | sense |
| 941-960 | 7431 | AGUGUCAGGGUCCACAAGC | 7432 | AGUGUcAGGGUCcAcAAGCdTsdT | antis |
| 943-962 | 7433 | UUGUGGACCCUGACACUGC | 7434 | uuGuGGAcccuGAcAcuGcdTsdT | sense |
| 943-962 | 7435 | GCAGUGUCAGGGUCCACAA | 7436 | GcAGUGUcAGGGUCcAcAAdTsdT | antis |
| 949-968 | 7437 | ACCCUGACACUGCUGUCCU | 7438 | AcccuGAcAcuGcuGuccudTsdT | sense |
| 949-968 | 7439 | AGGACAGCAGUGUCAGGGU | 7440 | AGGAcAGcAGUGUcAGGGUdTsdT | antis |
| 952-971 | 7441 | CUGACACUGCUGUCCUCAA | 7442 | cuGAcAcuGcuGuccucAAdTsdT | sense |
| 952-971 | 7443 | UUGAGGACAGCAGUGUCAG | 7444 | UUGAGGAcAGcAGUGUcAGdTsdT | antis |
| 970-989 | 7445 | AGCUCUGCGAUUUUGGCAG | 7446 | AGcucuGcGAuuuuGGcAGdTsdT | sense |
| 970-989 | 7447 | CUGCCAAAAUCGCAGAGCU | 7448 | CUGCcAAAAUCGcAGAGCUdTsdT | antis |
| 974-993 | 7449 | CUGCGAUUUUGGCAGUGCA | 7450 | cuGcGAuuuuGGcAGuGcAdTsdT | sense |
| 974-993 | 7451 | UGCACUGCCAAAAUCGCAG | 7452 | UGcACUGCcAAAAUCGcAGdTsdT | antis |
| 977-996 | 7453 | CGAUUUUGGCAGUGCAAAG | 7454 | cGAuuuuGGcAGuGcAAAGdTsdT | sense |
| 977-996 | 7455 | CUUUGCACUGCCAAAAUCG | 7456 | CUUUGcACUGCcAAAAUCGdTsdT | antis |
| 978-997 | 7457 | GAUUUUGGCAGUGCAAAGC | 7458 | GAuuuuGGcAGuGcAAAGcdTsdT | sense |
| 978-997 | 7459 | GCUUUGCACUGCCAAAAUC | 7460 | GCUUUGcACUGCcAAAAUCdTsdT | antis |
| 986-1005 | 7461 | CAGUGCAAAGCAGCUGGUU | 7462 | cAGuGcAAAGcAGcuGGuudTsdT | sense |
| 986-1005 | 7463 | AACCAGCUGCUUUGCACUG | 7464 | AACcAGCUGCUUUGcACUGdTsdT | antis |
| 987-1006 | 7465 | AGUGCAAAGCAGCUGGUUC | 7466 | AGuGcAAAGcAGcuGGuucdTsdT | sense |
| 987-1006 | 7467 | GAACCAGCUGCUUUGCACU | 7468 | GAACcAGCUGCUUUGcACUdTsdT | antis |
| 988-1007 | 7469 | GUGCAAAGCAGCUGGUUCG | 7470 | GuGcAAAGcAGcuGGuucGdTsdT | sense |
| 988-1007 | 7471 | CGAACCAGCUGCUUUGCAC | 7472 | CGAACcAGCUGCUUUGcACdTsdT | antis |
| 1162-1181 | 7473 | GUGGGGUGGACCAGCUUGU | 7474 | GuGGGGuGGAccAGcuuGudTsdT | sense |
| 1162-1181 | 7475 | ACAAGCUGGUCCACCCCAC | 7476 | AcAAGCUGGUCcACCCCACdTsdT | antis |
| 1163-1182 | 7477 | UGGGGUGGACCAGCUUGUG | 7478 | uGGGGuGGAccAGcuuGuGdTsdT | sense |
| 1163-1182 | 7479 | CACAAGCUGGUCCACCCCA | 7480 | cAcAAGCUGGUCcACCCcAdTsdT | antis |
| 1164-1183 | 7481 | GGGGUGGACCAGCUUGUGG | 7482 | GGGGuGGAccAGcuuGuGGdTsdT | sense |
| 1164-1183 | 7483 | CCACAAGCUGGUCCACCCC | 7484 | CcAcAAGCUGGUCcACCCCdTsdT | antis |
| 1165-1184 | 7485 | GGGUGGACCAGCUUGUGGA | 7486 | GGGuGGAccAGcuuGuGGAdTsdT | sense |
| 1165-1184 | 7487 | UCCACAAGCUGGUCCACCC | 7488 | UCcAcAAGCUGGUCcACCCdTsdT | antis |
| 1168-1187 | 7489 | UGGACCAGCUUGUGGAGAU | 7490 | uGGAccAGcuuGuGGAGAudTsdT | sense |
| 1168-1187 | 7491 | AUCUCCACAAGCUGGUCCA | 7492 | AUCUCcAcAAGCUGGUCcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1172-1191 | 7493 | CCAGCUUGUGGAGAUCAUC | 7494 | ccAGcuuGuGGAGAucAucdTsdT | sense |
| 1172-1191 | 7495 | GAUGAUCUCCACAAGCUGG | 7496 | GAUGAUCUCcAcAAGCUGGdTsdT | antis |
| 1173-1192 | 7497 | CAGCUUGUGGAGAUCAUCA | 7498 | cAGcuuGuGGAGAucAucAdTsdT | sense |
| 1173-1192 | 7499 | UGAUGAUCUCCACAAGCUG | 7500 | UGAUGAUCUCcAcAAGCUGdTsdT | antis |
| 1175-1194 | 7501 | GCUUGUGGAGAUCAUCAAG | 7502 | GcuuGuGGAGAucAucAAGdTsdT | sense |
| 1175-1194 | 7503 | CUUGAUGAUCUCCACAAGC | 7504 | CUUGAUGAUCUCcAcAAGCdTsdT | antis |
| 1176-1195 | 7505 | CUUGUGGAGAUCAUCAAGG | 7506 | cuuGuGGAGAucAucAAGGdTsdT | sense |
| 1176-1195 | 7507 | CCUUGAUGAUCUCCACAAG | 7508 | CCUUGAUGAUCUCcAcAAGdTsdT | antis |
| 1177-1196 | 7509 | UUGUGGAGAUCAUCAAGGU | 7510 | uuGuGGAGAucAucAAGGudTsdT | sense |
| 1177-1196 | 7511 | ACCUUGAUGAUCUCCACAA | 7512 | ACCUUGAUGAUCUCcAcAAdTsdT | antis |
| 1179-1198 | 7513 | GUGGAGAUCAUCAAGGUAC | 7514 | GuGGAGAucAucAAGGuAcdTsdT | sense |
| 1179-1198 | 7515 | GUACCUUGAUGAUCUCCAC | 7516 | GuACCUUGAUGAUCUCcACdTsdT | antis |
| 1180-1199 | 7517 | UGGAGAUCAUCAAGGUACU | 7518 | uGGAGAucAucAAGGuAcudTsdT | sense |
| 1180-1199 | 7519 | AGUACCUUGAUGAUCUCCA | 7520 | AGuACCUUGAUGAUCUCcAdTsdT | antis |
| 1181-1200 | 7521 | GGAGAUCAUCAAGGUACUA | 7522 | GGAGAucAucAAGGuAcuAdTsdT | sense |
| 1181-1200 | 7523 | UAGUACCUUGAUGAUCUCC | 7524 | uAGuACCUUGAUGAUCUCCdTsdT | antis |
| 1182-1201 | 7525 | GAGAUCAUCAAGGUACUAG | 7526 | GAGAucAucAAGGuAcuAGdTsdT | sense |
| 1182-1201 | 7527 | CUAGUACCUUGAUGAUCUC | 7528 | CuAGuACCUUGAUGAUCUCdTsdT | antis |
| 1184-1203 | 7529 | GAUCAUCAAGGUACUAGGA | 7530 | GAucAucAAGGuAcuAGGAdTsdT | sense |
| 1184-1203 | 7531 | UCCUAGUACCUUGAUGAUC | 7532 | UCCuAGuACCUUGAUGAUCdTsdT | antis |
| 1186-1205 | 7533 | UCAUCAAGGUACUAGGAAC | 7534 | ucAucAAGGuAcuAGGAAcdTsdT | sense |
| 1186-1205 | 7535 | GUUCCUAGUACCUUGAUGA | 7536 | GUUCCuAGuACCUUGAUGAdTsdT | antis |
| 1187-1206 | 7537 | CAUCAAGGUACUAGGAACG | 7538 | cAucAAGGuAcuAGGAAcGdTsdT | sense |
| 1187-1206 | 7539 | CGUUCCUAGUACCUUGAUG | 7540 | CGUUCCuAGuACCUUGAUGdTsdT | antis |
| 1205-1224 | 7541 | GCCAACCAGGGAACAAAUC | 7542 | GccAAccAGGGAAcAAAucdTsdT | sense |
| 1205-1224 | 7543 | GAUUUGUUCCCUGGUUGGC | 7544 | GAUUUGUUCCCUGGUUGGCdTsdT | antis |
| 1207-1226 | 7545 | CAACCAGGGAACAAAUCCG | 7546 | cAAccAGGGAAcAAAuccGdTsdT | sense |
| 1207-1226 | 7547 | CGGAUUUGUUCCCUGGUUG | 7548 | CGGAUUUGUUCCCUGGUUGdTsdT | antis |
| 1209-1228 | 7549 | ACCAGGGAACAAAUCCGAG | 7550 | AccAGGGAAcAAAuccGAGdTsdT | sense |
| 1209-1228 | 7551 | CUCGGAUUUGUUCCCUGGU | 7552 | CUCGGAUUUGUUCCCUGGUdTsdT | antis |
| 1212-1231 | 7553 | AGGGAACAAAUCCGAGAGA | 7554 | AGGGAAcAAAuccGAGAGAdTsdT | sense |
| 1212-1231 | 7555 | UCUCUCGGAUUUGUUCCCU | 7556 | UCUCUCGGAUUUGUUCCCUdTsdT | antis |
| 1214-1233 | 7557 | GGAACAAAUCCGAGAGAUG | 7558 | GGAAcAAAuccGAGAGAuGdTsdT | sense |
| 1214-1233 | 7559 | CAUCUCUCGGAUUUGUUCC | 7560 | cAUCUCUCGGAUUUGUUCCdTsdT | antis |
| 1219-1238 | 7561 | AAAUCCGAGAGAUGAACCC | 7562 | AAAuccGAGAGAuGAAcccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1219-1238 | 7563 | GGGUUCAUCUCUCGGAUUU | 7564 | GGGUUcAUCUCUCGGAUUUdTsdT | antis |
| 1222-1241 | 7565 | UCCGAGAGAUGAACCCUAA | 7566 | uccGAGAGAuGAAcccuAAdTsdT | sense |
| 1222-1241 | 7567 | UUAGGGUUCAUCUCUCGGA | 7568 | UuAGGGUUcAUCUCUCGGAdTsdT | antis |
| 1223-1242 | 7569 | CCGAGAGAUGAACCCUAAC | 7570 | ccGAGAGAuGAAcccuAAcdTsdT | sense |
| 1223-1242 | 7571 | GUUAGGGUUCAUCUCUCGG | 7572 | GUuAGGGUUcAUCUCUCGGdTsdT | antis |
| 1247-1266 | 7573 | GGAGUUCAAGUUCCCCCAG | 7574 | GGAGuucAAGuuccccAGdTsdT | sense |
| 1247-1266 | 7575 | CUGGGGGAACUUGAACUCC | 7576 | CUGGGGGAACUUGAACUCCdTsdT | antis |
| 1248-1267 | 7577 | GAGUUCAAGUUCCCCCAGA | 7578 | GAGuucAAGuuccccAGAdTsdT | sense |
| 1248-1267 | 7579 | UCUGGGGGAACUUGAACUC | 7580 | UCUGGGGGAACUUGAACUCdTsdT | antis |
| 1249-1268 | 7581 | AGUUCAAGUUCCCCCAGAU | 7582 | AGuucAAGuuccccAGAudTsdT | sense |
| 1249-1268 | 7583 | AUCUGGGGGAACUUGAACU | 7584 | AUCUGGGGGAACUUGAACUdTsdT | antis |
| 1250-1269 | 7585 | GUUCAAGUUCCCCCAGAUC | 7586 | GuucAAGuuccccAGAucdTsdT | sense |
| 1250-1269 | 7587 | GAUCUGGGGGAACUUGAAC | 7588 | GAUCUGGGGGAACUUGAACdTsdT | antis |
| 1251-1270 | 7589 | UUCAAGUUCCCCCAGAUCA | 7590 | uucAAGuuccccAGAucAdTsdT | sense |
| 1251-1270 | 7591 | UGAUCUGGGGGAACUUGAA | 7592 | UGAUCUGGGGGAACUUGAAdTsdT | antis |
| 1252-1271 | 7593 | UCAAGUUCCCCCAGAUCAA | 7594 | ucAAGuuccccAGAucAAdTsdT | sense |
| 1252-1271 | 7595 | UUGAUCUGGGGGAACUUGA | 7596 | UUGAUCUGGGGGAACUUGAdTsdT | antis |
| 1253-1272 | 7597 | CAAGUUCCCCCAGAUCAAA | 7598 | cAAGuuccccAGAucAAAdTsdT | sense |
| 1253-1272 | 7599 | UUUGAUCUGGGGGAACUUG | 7600 | UUUGAUCUGGGGGAACUUGdTsdT | antis |
| 1255-1274 | 7601 | AGUUCCCCCAGAUCAAAGC | 7602 | AGuuccccAGAucAAAGcdTsdT | sense |
| 1255-1274 | 7603 | GCUUUGAUCUGGGGGAACU | 7604 | GCUUUGAUCUGGGGGAACUdTsdT | antis |
| 1257-1276 | 7605 | UUCCCCCAGAUCAAAGCUC | 7606 | uuccccAGAucAAAGcucdTsdT | sense |
| 1257-1276 | 7607 | GAGCUUUGAUCUGGGGGAA | 7608 | GAGCUUUGAUCUGGGGGAAdTsdT | antis |
| 1258-1277 | 7609 | UCCCCCAGAUCAAAGCUCA | 7610 | uccccAGAucAAAGcucAdTsdT | sense |
| 1258-1277 | 7611 | UGAGCUUUGAUCUGGGGGA | 7612 | UGAGCUUUGAUCUGGGGGAdTsdT | antis |
| 1261-1280 | 7613 | CCCAGAUCAAAGCUCACCC | 7614 | cccAGAucAAAGcucAcccdTsdT | sense |
| 1261-1280 | 7615 | GGGUGAGCUUUGAUCUGGG | 7616 | GGGUGAGCUUUGAUCUGGGdTsdT | antis |
| 1262-1281 | 7617 | CCAGAUCAAAGCUCACCCU | 7618 | ccAGAucAAAGcucAcccudTsdT | sense |
| 1262-1281 | 7619 | AGGGUGAGCUUUGAUCUGG | 7620 | AGGGUGAGCUUUGAUCUGGdTsdT | antis |
| 1280-1299 | 7621 | UUGGACAAAGGUGUUCAAA | 7622 | uuGGAcAAAGGuGuucAAAdTsdT | sense |
| 1280-1299 | 7623 | UUUGAACACCUUUGUCCAA | 7624 | UUUGAAcACCUUUGUCcAAdTsdT | antis |
| 1282-1301 | 7625 | GGACAAAGGUGUUCAAAUC | 7626 | GGAcAAAGGuGuucAAAucdTsdT | sense |
| 1282-1301 | 7627 | GAUUUGAACACCUUUGUCC | 7628 | GAUUUGAAcACCUUUGUCCdTsdT | antis |
| 1283-1302 | 7629 | GACAAAGGUGUUCAAAUCU | 7630 | GAcAAAGGuGuucAAAucudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1283-1302 | 7631 | AGAUUUGAACACCUUUGUC | 7632 | AGAUUUGAAcACCUUUGUCdTsdT | antis |
| 1284-1303 | 7633 | ACAAAGGUGUUCAAAUCUU | 7634 | AcAAAGGuGuucAAAucuudTsdT | sense |
| 1284-1303 | 7635 | AAGAUUUGAACACCUUUGU | 7636 | AAGAUUUGAAcACCUUUGUdTsdT | antis |
| 1354-1373 | 7637 | CGCCAUCCUCAAGGCUCUC | 7638 | cGccAuccucAAGGcucucdTsdT | sense |
| 1354-1373 | 7639 | GAGAGCCUUGAGGAUGGCG | 7640 | GAGAGCCUUGAGGAUGGCGdTsdT | antis |
| 1361-1380 | 7641 | CUCAAGGCUCUCCCCACUC | 7642 | cucAAGGcucuccccAcucdTsdT | sense |
| 1361-1380 | 7643 | GAGUGGGGAGAGCCUUGAG | 7644 | GAGUGGGGAGAGCCUUGAGdTsdT | antis |
| 1379-1398 | 7645 | CGAGGCUUGUGCCCACAGC | 7646 | cGAGGcuuGuGcccAcAGcdTsdT | sense |
| 1379-1398 | 7647 | GCUGUGGGCACAAGCCUCG | 7648 | GCUGUGGGcAcAAGCCUCGdTsdT | antis |
| 1380-1399 | 7649 | GAGGCUUGUGCCCACAGCU | 7650 | GAGGcuuGuGcccAcAGcudTsdT | sense |
| 1380-1399 | 7651 | AGCUGUGGGCACAAGCCUC | 7652 | AGCUGUGGGcAcAAGCCUCdTsdT | antis |
| 1382-1401 | 7653 | GGCUUGUGCCCACAGCUUC | 7654 | GGcuuGuGcccAcAGcuucdTsdT | sense |
| 1382-1401 | 7655 | GAAGCUGUGGGCACAAGCC | 7656 | GAAGCUGUGGGcAcAAGCCdTsdT | antis |
| 1383-1402 | 7657 | GCUUGUGCCCACAGCUUCU | 7658 | GcuuGuGcccAcAGcuucudTsdT | sense |
| 1383-1402 | 7659 | AGAAGCUGUGGGCACAAGC | 7660 | AGAAGCUGUGGGcAcAAGCdTsdT | antis |
| 1384-1403 | 7661 | CUUGUGCCCACAGCUUCUU | 7662 | cuuGuGcccAcAGcuucuudTsdT | sense |
| 1384-1403 | 7663 | AAGAAGCUGUGGGCACAAG | 7664 | AAGAAGCUGUGGGcAcAAGdTsdT | antis |
| 1386-1405 | 7665 | UGUGCCCACAGCUUCUUCG | 7666 | uGuGcccAcAGcuucuucGdTsdT | sense |
| 1386-1405 | 7667 | CGAAGAAGCUGUGGGCACA | 7668 | CGAAGAAGCUGUGGGcAcAdTsdT | antis |
| 1424-1443 | 7669 | AGCCCAGCUCCCCAACGAC | 7670 | AGcccAGcuccccAAcGAcdTsdT | sense |
| 1424-1443 | 7671 | GUCGUUGGGGAGCUGGGCU | 7672 | GUCGUUGGGGAGCUGGGCUdTsdT | antis |
| 1425-1444 | 7673 | GCCCAGCUCCCCAACGACC | 7674 | GcccAGcuccccAAcGAccdTsdT | sense |
| 1425-1444 | 7675 | GGUCGUUGGGGAGCUGGGC | 7676 | GGUCGUUGGGGAGCUGGGCdTsdT | antis |
| 1426-1445 | 7677 | CCCAGCUCCCCAACGACCG | 7678 | cccAGcuccccAAcGAccGdTsdT | sense |
| 1426-1445 | 7679 | CGGUCGUUGGGGAGCUGGG | 7680 | CGGUCGUUGGGGAGCUGGGdTsdT | antis |
| 1427-1446 | 7681 | CCAGCUCCCCAACGACCGC | 7682 | ccAGcuccccAAcGAccGcdTsdT | sense |
| 1427-1446 | 7683 | GCGGUCGUUGGGGAGCUGG | 7684 | GCGGUCGUUGGGGAGCUGGdTsdT | antis |
| 1428-1447 | 7685 | CAGCUCCCCAACGACCGCC | 7686 | cAGcuccccAAcGAccGccdTsdT | sense |
| 1428-1447 | 7687 | GGCGGUCGUUGGGGAGCUG | 7688 | GGCGGUCGUUGGGGAGCUGdTsdT | antis |
| 1454-1473 | 7689 | CCCCCUGUUCAACUUCAGU | 7690 | cccccuGuucAAcuucAGudTsdT | sense |
| 1454-1473 | 7691 | ACUGAAGUUGAACAGGGGG | 7692 | ACUGAAGUUGAAcAGGGGGdTsdT | antis |
| 1459-1478 | 7693 | UGUUCAACUUCAGUCCUGG | 7694 | uGuucAAcuucAGuccuGGdTsdT | sense |
| 1459-1478 | 7695 | CCAGGACUGAAGUUGAACA | 7696 | CcAGGACUGAAGUUGAAcAdTsdT | antis |
| 1460-1479 | 7697 | GUUCAACUUCAGUCCUGGU | 7698 | GuucAAcuucAGuccuGGudTsdT | sense |
| 1460-1479 | 7699 | ACCAGGACUGAAGUUGAAC | 7700 | ACcAGGACUGAAGUUGAACdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1461-1480 | 7701 | UUCAACUUCAGUCCUGGUG | 7702 | uucAAcuucAGuccuGGuGdTsdT | sense |
| 1461-1480 | 7703 | CACCAGGACUGAAGUUGAA | 7704 | cAccAGGACUGAAGUUGAAdTsdT | antis |
| 1462-1481 | 7705 | UCAACUUCAGUCCUGGUGA | 7706 | ucAAcuucAGuccuGGuGAdTsdT | sense |
| 1462-1481 | 7707 | UCACCAGGACUGAAGUUGA | 7708 | UcACcAGGACUGAAGUUGAdTsdT | antis |
| 1463-1482 | 7709 | CAACUUCAGUCCUGGUGAA | 7710 | cAAcuucAGuccuGGuGAAdTsdT | sense |
| 1463-1482 | 7711 | UUCACCAGGACUGAAGUUG | 7712 | UUcAccAGGACUGAAGUUGdTsdT | antis |
| 1503-1522 | 7713 | AAUGCCAUUCUCAUCCCUC | 7714 | AAuGccAuucucAucccucdTsdT | sense |
| 1503-1522 | 7715 | GAGGGAUGAGAAUGGCAUU | 7716 | GAGGGAUGAGAAUGGcAUUdTsdT | antis |
| 1504-1523 | 7717 | AUGCCAUUCUCAUCCCUCC | 7718 | AuGccAuucucAucccuccdTsdT | sense |
| 1504-1523 | 7719 | GGAGGGAUGAGAAUGGCAU | 7720 | GGAGGGAUGAGAAUGGcAUdTsdT | antis |
| 1505-1524 | 7721 | UGCCAUUCUCAUCCCUCCU | 7722 | uGccAuucucAucccuccudTsdT | sense |
| 1505-1524 | 7723 | AGGAGGGAUGAGAAUGGCA | 7724 | AGGAGGGAUGAGAAUGGcAdTsdT | antis |
| 1506-1525 | 7725 | GCCAUUCUCAUCCCUCCUC | 7726 | GccAuucucAucccuccucdTsdT | sense |
| 1506-1525 | 7727 | GAGGAGGGAUGAGAAUGGC | 7728 | GAGGAGGGAUGAGAAUGGCdTsdT | antis |
| 1507-1526 | 7729 | CCAUUCUCAUCCCUCCUCA | 7730 | ccAuucucAucccuccucAdTsdT | sense |
| 1507-1526 | 7731 | UGAGGAGGGAUGAGAAUGG | 7732 | UGAGGAGGGAUGAGAAUGGdTsdT | antis |
| 1508-1527 | 7733 | CAUUCUCAUCCCUCCUCAC | 7734 | cAuucucAucccuccucAcdTsdT | sense |
| 1508-1527 | 7735 | GUGAGGAGGGAUGAGAAUG | 7736 | GUGAGGAGGGAUGAGAAUGdTsdT | antis |
| 1509-1528 | 7737 | AUUCUCAUCCCUCCUCACU | 7738 | AuucucAucccuccucAcudTsdT | sense |
| 1509-1528 | 7739 | AGUGAGGAGGGAUGAGAAU | 7740 | AGUGAGGAGGGAUGAGAAUdTsdT | antis |
| 1510-1529 | 7741 | UUCUCAUCCCUCCUCACUU | 7742 | uucucAucccuccucAcuudTsdT | sense |
| 1510-1529 | 7743 | AAGUGAGGAGGGAUGAGAA | 7744 | AAGUGAGGAGGGAUGAGAAdTsdT | antis |
| 1511-1530 | 7745 | UCUCAUCCCUCCUCACUUG | 7746 | ucucAucccuccucAcuuGdTsdT | sense |
| 1511-1530 | 7747 | CAAGUGAGGAGGGAUGAGA | 7748 | cAAGUGAGGAGGGAUGAGAdTsdT | antis |
| 1515-1534 | 7749 | AUCCCUCCUCACUUGAGGU | 7750 | AucccuccucAcuuGAGGudTsdT | sense |
| 1515-1534 | 7751 | ACCUCAAGUGAGGAGGGAU | 7752 | ACCUcAAGUGAGGAGGGAUdTsdT | antis |
| 1516-1535 | 7753 | UCCCUCCUCACUUGAGGUC | 7754 | ucccuccucAcuuGAGGucdTsdT | sense |
| 1516-1535 | 7755 | GACCUCAAGUGAGGAGGGA | 7756 | GACCUcAAGUGAGGAGGGAdTsdT | antis |
| 1520-1539 | 7757 | UCCUCACUUGAGGUCCCCA | 7758 | uccucAcuuGAGGuccccAdTsdT | sense |
| 1520-1539 | 7759 | UGGGGACCUCAAGUGAGGA | 7760 | UGGGGACCUcAAGUGAGGAdTsdT | antis |
| 1522-1541 | 7761 | CUCACUUGAGGUCCCCAGC | 7762 | cucAcuuGAGGuccccAGcdTsdT | sense |
| 1522-1541 | 7763 | GCUGGGGACCUCAAGUGAG | 7764 | GCUGGGGACCUcAAGUGAGdTsdT | antis |
| 1523-1542 | 7765 | UCACUUGAGGUCCCCAGCA | 7766 | ucAcuuGAGGuccccAGcAdTsdT | sense |
| 1523-1542 | 7767 | UGCUGGGGACCUCAAGUGA | 7768 | UGCUGGGGACCUcAAGUGAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1524-1543 | 7769 | CACUUGAGGUCCCCAGCAG | 7770 | cAcuuGAGGuccccAGcAGdTsdT | sense |
| 1524-1543 | 7771 | CUGCUGGGGACCUCAAGUG | 7772 | CUGCUGGGGACCUcAAGUGdTsdT | antis |
| 1528-1547 | 7773 | UGAGGUCCCCAGCAGGCCC | 7774 | uGAGGuccccAGcAGGcccdTsdT | sense |
| 1528-1547 | 7775 | GGGCCUGCUGGGGACCUCA | 7776 | GGGCCUGCUGGGGACCUcAdTsdT | antis |
| 1529-1548 | 7777 | GAGGUCCCCAGCAGGCCCU | 7778 | GAGGuccccAGcAGGcccudTsdT | sense |
| 1529-1548 | 7779 | AGGGCCUGCUGGGGACCUC | 7780 | AGGGCCUGCUGGGGACCUCdTsdT | antis |
| 1539-1558 | 7781 | GCAGGCCCUGCUUCUCCCC | 7782 | GcAGGcccuGcuucuccccdTsdT | sense |
| 1539-1558 | 7783 | GGGGAGAAGCAGGGCCUGC | 7784 | GGGGAGAAGcAGGGCCUGCdTsdT | antis |
| 1577-1596 | 7785 | AUCCUCACAAGCUUUAACU | 7786 | AuccucAcAAGcuuuAAcudTsdT | sense |
| 1577-1596 | 7787 | AGUUAAAGCUUGUGAGGAU | 7788 | AGUuAAAGCUUGUGAGGAUdTsdT | antis |
| 1578-1597 | 7789 | UCCUCACAAGCUUUAACUG | 7790 | uccucAcAAGcuuuAAcuGdTsdT | sense |
| 1578-1597 | 7791 | CAGUUAAAGCUUGUGAGGA | 7792 | cAGUuAAAGCUUGUGAGGAdTsdT | antis |
| 1579-1598 | 7793 | CCUCACAAGCUUUAACUGA | 7794 | ccucAcAAGcuuuAAcuGAdTsdT | sense |
| 1579-1598 | 7795 | UCAGUUAAAGCUUGUGAGG | 7796 | UcAGUuAAAGCUUGUGAGGdTsdT | antis |
| 1582-1601 | 7797 | CACAAGCUUUAACUGAAGC | 7798 | cAcAAGcuuuAAcuGAAGcdTsdT | sense |
| 1582-1601 | 7799 | GCUUCAGUUAAAGCUUGUG | 7800 | GCUUcAGUuAAAGCUUGUGdTsdT | antis |
| 1587-1606 | 7801 | GCUUUAACUGAAGCUCAGA | 7802 | GcuuuAAcuGAAGcucAGAdTsdT | sense |
| 1587-1606 | 7803 | UCUGAGCUUCAGUUAAAGC | 7804 | UCUGAGCUUcAGUuAAAGCdTsdT | antis |
| 1623-1642 | 7805 | CCAUCUGAUGCCACAACUG | 7806 | ccAucuGAuGccAcAAcuGdTsdT | sense |
| 1623-1642 | 7807 | CAGUUGUGGCAUCAGAUGG | 7808 | cAGUUGUGGcAUcAGAUGGdTsdT | antis |
| 1624-1643 | 7809 | CAUCUGAUGCCACAACUGC | 7810 | cAucuGAuGccAcAAcuGcdTsdT | sense |
| 1624-1643 | 7811 | GCAGUUGUGGCAUCAGAUG | 7812 | GcAGUUGUGGcAUcAGAUGdTsdT | antis |
| 1625-1644 | 7813 | AUCUGAUGCCACAACUGCU | 7814 | AucuGAuGccAcAAcuGcudTsdT | sense |
| 1625-1644 | 7815 | AGCAGUUGUGGCAUCAGAU | 7816 | AGcAGUUGUGGcAUcAGAUdTsdT | antis |
| 1630-1649 | 7817 | AUGCCACAACUGCUACCCU | 7818 | AuGccAcAAcuGcuAcccudTsdT | sense |
| 1630-1649 | 7819 | AGGGUAGCAGUUGUGGCAU | 7820 | AGGGuAGcAGUUGUGGcAUdTsdT | antis |
| 1631-1650 | 7821 | UGCCACAACUGCUACCCUC | 7822 | uGccAcAAcuGcuAcccucdTsdT | sense |
| 1631-1650 | 7823 | GAGGGUAGCAGUUGUGGCA | 7824 | GAGGGuAGcAGUUGUGGcAdTsdT | antis |
| 1632-1651 | 7825 | GCCACAACUGCUACCCUCG | 7826 | GccAcAAcuGcuAcccucGdTsdT | sense |
| 1632-1651 | 7827 | CGAGGGUAGCAGUUGUGGC | 7828 | CGAGGGuAGcAGUUGUGGCdTsdT | antis |
| 1633-1652 | 7829 | CCACAACUGCUACCCUCGC | 7830 | ccAcAAcuGcuAcccucGcdTsdT | sense |
| 1633-1652 | 7831 | GCGAGGGUAGCAGUUGUGG | 7832 | GCGAGGGuAGcAGUUGUGGdTsdT | antis |
| 1668-1687 | 7833 | CCCCACCGACUACCCCUCC | 7834 | ccccAccGAcuAccccuccdTsdT | sense |
| 1668-1687 | 7835 | GGAGGGGUAGUCGGUGGGG | 7836 | GGAGGGGuAGUCGGUGGGGdTsdT | antis |
| 1678-1697 | 7837 | UACCCCUCCACGUCCAUCU | 7838 | uAccccuccAcGuccAucudTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1678-1697 | 7839 | AGAUGGACGUGGAGGGGUA | 7840 | AGAUGGACGUGGAGGGGuAdTsdT | antis |
| 1681-1700 | 7841 | CCCUCCACGUCCAUCUGGG | 7842 | cccuccAcGuccAucuGGGdTsdT | sense |
| 1681-1700 | 7843 | CCCAGAUGGACGUGGAGGG | 7844 | CCcAGAUGGACGUGGAGGGdTsdT | antis |
| 1683-1702 | 7845 | CUCCACGUCCAUCUGGGAA | 7846 | cuccAcGuccAucuGGGAAdTsdT | sense |
| 1683-1702 | 7847 | UUCCCAGAUGGACGUGGAG | 7848 | UUCCcAGAUGGACGUGGAGdTsdT | antis |
| 1690-1709 | 7849 | UCCAUCUGGGAAGGCCCAA | 7850 | uccAucuGGGAAGGcccAAdTsdT | sense |
| 1690-1709 | 7851 | UUGGGCCUUCCCAGAUGGA | 7852 | UUGGGCCUUCCcAGAUGGAdTsdT | antis |
| 1691-1710 | 7853 | CCAUCUGGGAAGGCCCAAG | 7854 | ccAucuGGGAAGGcccAAGdTsdT | sense |
| 1691-1710 | 7855 | CUUGGGCCUUCCCAGAUGG | 7856 | CUUGGGCCUUCCcAGAUGGdTsdT | antis |
| 1692-1711 | 7857 | CAUCUGGGAAGGCCCAAGU | 7858 | cAucuGGGAAGGcccAAGudTsdT | sense |
| 1692-1711 | 7859 | ACUUGGGCCUUCCCAGAUG | 7860 | ACUUGGGCCUUCCcAGAUGdTsdT | antis |
| 1693-1712 | 7861 | AUCUGGGAAGGCCCAAGUG | 7862 | AucuGGGAAGGcccAAGuGdTsdT | sense |
| 1693-1712 | 7863 | CACUUGGGCCUUCCCAGAU | 7864 | cACUUGGGCCUUCCcAGAUdTsdT | antis |
| 1696-1715 | 7865 | UGGGAAGGCCCAAGUGGCG | 7866 | uGGGAAGGcccAAGuGGcGdTsdT | sense |
| 1696-1715 | 7867 | CGCCACUUGGGCCUUCCCA | 7868 | CGCcACUUGGGCCUUCCcAdTsdT | antis |
| 1697-1716 | 7869 | GGGAAGGCCCAAGUGGCGC | 7870 | GGGAAGGcccAAGuGGcGcdTsdT | sense |
| 1697-1716 | 7871 | GCGCCACUUGGGCCUUCCC | 7872 | GCGCcACUUGGGCCUUCCCdTsdT | antis |
| 1698-1717 | 7873 | GGAAGGCCCAAGUGGCGCU | 7874 | GGAAGGcccAAGuGGcGcudTsdT | sense |
| 1698-1717 | 7875 | AGCGCCACUUGGGCCUUCC | 7876 | AGCGCcACUUGGGCCUUCCdTsdT | antis |
| 1699-1718 | 7877 | GAAGGCCCAAGUGGCGCUG | 7878 | GAAGGcccAAGuGGcGcuGdTsdT | sense |
| 1699-1718 | 7879 | CAGCGCCACUUGGGCCUUC | 7880 | cAGCGCcACUUGGGCCUUCdTsdT | antis |
| 1700-1719 | 7881 | AAGGCCCAAGUGGCGCUGG | 7882 | AAGGcccAAGuGGcGcuGGdTsdT | sense |
| 1700-1719 | 7883 | CCAGCGCCACUUGGGCCUU | 7884 | CcAGCGCcACUUGGGCCUUdTsdT | antis |
| 1701-1720 | 7885 | AGGCCCAAGUGGCGCUGGG | 7886 | AGGcccAAGuGGcGcuGGGdTsdT | sense |
| 1701-1720 | 7887 | CCCAGCGCCACUUGGGCCU | 7888 | CCcAGCGCcACUUGGGCCUdTsdT | antis |
| 1702-1721 | 7889 | GGCCCAAGUGGCGCUGGGA | 7890 | GGcccAAGuGGcGcuGGGAdTsdT | sense |
| 1702-1721 | 7891 | UCCCAGCGCCACUUGGGCC | 7892 | UCCcAGCGCcACUUGGGCCdTsdT | antis |
| 1707-1726 | 7893 | AAGUGGCGCUGGGAAGGGG | 7894 | AAGuGGcGcuGGGAAGGGGdTsdT | sense |
| 1707-1726 | 7895 | CCCCUUCCCAGCGCCACUU | 7896 | CCCCUUCCcAGCGCcACUUdTsdT | antis |
| 1708-1727 | 7897 | AGUGGCGCUGGGAAGGGGG | 7898 | AGuGGcGcuGGGAAGGGGGdTsdT | sense |
| 1708-1727 | 7899 | CCCCCUUCCCAGCGCCACU | 7900 | CCCCCUUCCcAGCGCcACUdTsdT | antis |
| 1712-1731 | 7901 | GCGCUGGGAAGGGGCCAC | 7902 | GcGcuGGGAAGGGGGccAcdTsdT | sense |
| 1712-1731 | 7903 | GUGGCCCCCUUCCCAGCGC | 7904 | GUGGCCCCCUUCCcAGCGCdTsdT | antis |
| 1713-1732 | 7905 | CGCUGGGAAGGGGGCCACA | 7906 | cGcuGGGAAGGGGGccAcAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1713-1732 | 7907 | UGUGGCCCCCUUCCCAGCG | 7908 | UGUGGCCCCCUUCCcAGCGdTsdT | antis |
| 1715-1734 | 7909 | CUGGGAAGGGGGCCACAGC | 7910 | cuGGGAAGGGGGccAcAGcdTsdT | sense |
| 1715-1734 | 7911 | GCUGUGGCCCCCUUCCCAG | 7912 | GCUGUGGCCCCCUUCCcAGdTsdT | antis |
| 1716-1735 | 7913 | UGGGAAGGGGGCCACAGCC | 7914 | uGGGAAGGGGGccAcAGccdTsdT | sense |
| 1716-1735 | 7915 | GGCUGUGGCCCCCUUCCCA | 7916 | GGCUGUGGCCCCCUUCCcAdTsdT | antis |
| 1717-1736 | 7917 | GGGAAGGGGGCCACAGCCC | 7918 | GGGAAGGGGGccAcAGcccdTsdT | sense |
| 1717-1736 | 7919 | GGGCUGUGGCCCCCUUCCC | 7920 | GGGCUGUGGCCCCCUUCCCdTsdT | antis |
| 1718-1737 | 7921 | GGAAGGGGGCCACAGCCCA | 7922 | GGAAGGGGGccAcAGcccAdTsdT | sense |
| 1718-1737 | 7923 | UGGGCUGUGGCCCCCUUCC | 7924 | UGGGCUGUGGCCCCCUUCCdTsdT | antis |
| 1719-1738 | 7925 | GAAGGGGGCCACAGCCCAU | 7926 | GAAGGGGGccAcAGcccAudTsdT | sense |
| 1719-1738 | 7927 | AUGGGCUGUGGCCCCCUUC | 7928 | AUGGGCUGUGGCCCCCUUCdTsdT | antis |
| 1720-1739 | 7929 | AAGGGGGCCACAGCCCAUC | 7930 | AAGGGGGccAcAGcccAucdTsdT | sense |
| 1720-1739 | 7931 | GAUGGGCUGUGGCCCCCUU | 7932 | GAUGGGCUGUGGCCCCCUUdTsdT | antis |
| 1721-1740 | 7933 | AGGGGGCCACAGCCCAUCA | 7934 | AGGGGGccAcAGcccAucAdTsdT | sense |
| 1721-1740 | 7935 | UGAUGGGCUGUGGCCCCCU | 7936 | UGAUGGGCUGUGGCCCCCUdTsdT | antis |
| 1724-1743 | 7937 | GGGCCACAGCCCAUCAAGC | 7938 | GGGccAcAGcccAucAAGcdTsdT | sense |
| 1724-1743 | 7939 | GCUUGAUGGGCUGUGGCCC | 7940 | GCUUGAUGGGCUGUGGCCCdTsdT | antis |
| 1725-1744 | 7941 | GGCCACAGCCCAUCAAGCU | 7942 | GGccAcAGcccAucAAGcudTsdT | sense |
| 1725-1744 | 7943 | AGCUUGAUGGGCUGUGGCC | 7944 | AGCUUGAUGGGCUGUGGCCdTsdT | antis |
| 1727-1746 | 7945 | CCACAGCCCAUCAAGCUCC | 7946 | ccAcAGcccAucAAGcuccdTsdT | sense |
| 1727-1746 | 7947 | GGAGCUUGAUGGGCUGUGG | 7948 | GGAGCUUGAUGGGCUGUGGdTsdT | antis |
| 1728-1747 | 7949 | CACAGCCCAUCAAGCUCCU | 7950 | cAcAGcccAucAAGcuccudTsdT | sense |
| 1728-1747 | 7951 | AGGAGCUUGAUGGGCUGUG | 7952 | AGGAGCUUGAUGGGCUGUGdTsdT | antis |
| 1729-1748 | 7953 | ACAGCCCAUCAAGCUCCUG | 7954 | AcAGcccAucAAGcuccuGdTsdT | sense |
| 1729-1748 | 7955 | CAGGAGCUUGAUGGGCUGU | 7956 | cAGGAGCUUGAUGGGCUGUdTsdT | antis |
| 1733-1752 | 7957 | CCCAUCAAGCUCCUGCCCU | 7958 | cccAucAAGcuccuGcccudTsdT | sense |
| 1733-1752 | 7959 | AGGGCAGGAGCUUGAUGGG | 7960 | AGGGcAGGAGCUUGAUGGGdTsdT | antis |
| 1734-1753 | 7961 | CCAUCAAGCUCCUGCCCUG | 7962 | ccAucAAGcuccuGcccuGdTsdT | sense |
| 1734-1753 | 7963 | CAGGGCAGGAGCUUGAUGG | 7964 | cAGGGcAGGAGCUUGAUGGdTsdT | antis |
| 1735-1754 | 7965 | CAUCAAGCUCCUGCCCUGG | 7966 | cAucAAGcuccuGcccuGGdTsdT | sense |
| 1735-1754 | 7967 | CCAGGGCAGGAGCUUGAUG | 7968 | CcAGGGcAGGAGCUUGAUGdTsdT | antis |
| 1736-1755 | 7969 | AUCAAGCUCCUGCCCUGGC | 7970 | AucAAGcuccuGcccuGGcdTsdT | sense |
| 1736-1755 | 7971 | GCCAGGGCAGGAGCUUGAU | 7972 | GCcAGGGcAGGAGCUUGAUdTsdT | antis |
| 1738-1757 | 7973 | CAAGCUCCUGCCCUGGCUG | 7974 | cAAGcuccuGcccuGGcuGdTsdT | sense |
| 1738-1757 | 7975 | CAGCCAGGGCAGGAGCUUG | 7976 | cAGCcAGGGcAGGAGCUUGdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1739-1758 | 7977 | AAGCUCCUGCCCUGGCUGG | 7978 | AAGcuccuGcccuGGcuGGdTsdT | sense |
| 1739-1758 | 7979 | CCAGCCAGGGCAGGAGCUU | 7980 | CcAGCcAGGGcAGGAGCUUdTsdT | antis |
| 1742-1761 | 7981 | CUCCUGCCCUGGCUGGGCC | 7982 | cuccuGcccuGGcuGGGccdTsdT | sense |
| 1742-1761 | 7983 | GGCCCAGCCAGGGCAGGAG | 7984 | GGCCcAGCcAGGGcAGGAGdTsdT | antis |
| 1745-1764 | 7985 | CUGCCCUGGCUGGGCCCCU | 7986 | cuGcccuGGcuGGGccccudTsdT | sense |
| 1745-1764 | 7987 | AGGGGCCCAGCCAGGGCAG | 7988 | AGGGGCCcAGCcAGGGcAGdTsdT | antis |
| 1747-1766 | 7989 | GCCCUGGCUGGGCCCCUAG | 7990 | GcccuGGcuGGGccccuAGdTsdT | sense |
| 1747-1766 | 7991 | CUAGGGGCCCAGCCAGGGC | 7992 | CuAGGGGCCcAGCcAGGGCdTsdT | antis |
| 1749-1768 | 7993 | CCUGGCUGGGCCCCUAGAC | 7994 | ccuGGcuGGGccccuAGAcdTsdT | sense |
| 1749-1768 | 7995 | GUCUAGGGGCCCAGCCAGG | 7996 | GUCuAGGGGCCcAGCcAGGdTsdT | antis |
| 1750-1769 | 7997 | CUGGCUGGGCCCCUAGACU | 7998 | cuGGcuGGGccccuAGAcudTsdT | sense |
| 1750-1769 | 7999 | AGUCUAGGGGCCCAGCCAG | 8000 | AGUCuAGGGGCCcAGCcAGdTsdT | antis |
| 1751-1770 | 8001 | UGGCUGGGCCCCUAGACUA | 8002 | uGGcuGGGccccuAGAcuAdTsdT | sense |
| 1751-1770 | 8003 | UAGUCUAGGGGCCCAGCCA | 8004 | uAGUCuAGGGGCCCAGCcAdTsdT | antis |
| 1754-1773 | 8005 | CUGGGCCCCUAGACUAGAG | 8006 | cuGGGccccuAGAcuAGAGdTsdT | sense |
| 1754-1773 | 8007 | CUCUAGUCUAGGGGCCCAG | 8008 | CUCuAGUCuAGGGGCCcAGdTsdT | antis |
| 1756-1775 | 8009 | GGGCCCCUAGACUAGAGGG | 8010 | GGGccccuAGAcuAGAGGGdTsdT | sense |
| 1756-1775 | 8011 | CCCUCUAGUCUAGGGGCCC | 8012 | CCCUCuAGUCuAGGGGCCCdTsdT | antis |
| 1757-1776 | 8013 | GGCCCCUAGACUAGAGGGC | 8014 | GGccccuAGAcuAGAGGGcdTsdT | sense |
| 1757-1776 | 8015 | GCCCUCUAGUCUAGGGGCC | 8016 | GCCCUCuAGUCuAGGGGCCdTsdT | antis |
| 1762-1781 | 8017 | CUAGACUAGAGGGCAGAGG | 8018 | cuAGAcuAGAGGGcAGAGGdTsdT | sense |
| 1762-1781 | 8019 | CCUCUGCCCUCUAGUCUAG | 8020 | CCUCUGCCCUcAGUCuAGdTsdT | antis |
| 1766-1785 | 8021 | ACUAGAGGGCAGAGGUAAA | 8022 | AcuAGAGGGcAGAGGuAAAdTsdT | sense |
| 1766-1785 | 8023 | UUUACCUCUGCCCUCUAGU | 8024 | UUuACCUCUGCCCUCuAGUdTsdT | antis |
| 1768-1787 | 8025 | UAGAGGGCAGAGGUAAAUG | 8026 | uAGAGGGcAGAGGuAAAuGdTsdT | sense |
| 1768-1787 | 8027 | CAUUUACCUCUGCCCUCUA | 8028 | cAUUuACCUCUGCCCUcuAdTsdT | antis |
| 1771-1790 | 8029 | AGGGCAGAGGUAAAUGAAC | 8030 | AGGGcAGAGGuAAAuGAAcdTsdT | sense |
| 1771-1790 | 8031 | GUUCAUUUACCUCUGCCCU | 8032 | GUUcAUUuACCUCUGCCCUdTsdT | antis |
| 1776-1795 | 8033 | AGAGGUAAAUGAACUACCC | 8034 | AGAGGuAAAuGAAcuAcccdTsdT | sense |
| 1776-1795 | 8035 | GGGUAGUUCAUUUACCUCU | 8036 | GGGuAGUUcAUUuACCUCUdTsdT | antis |
| 1783-1802 | 8037 | AAUGAACUACCCCAGCAU | 8038 | AAuGAAcuAccccAGcAudTsdT | sense |
| 1783-1802 | 8039 | AUGCUGGGGUAGUUCAUU | 8040 | AUGCUGGGGuAGUUcAUUdTsdT | antis |
| 1788-1807 | 8041 | ACUACCCCAGCAUCUAGG | 8042 | AcuAccccAGcAucuAGGdTsdT | sense |
| 1788-1807 | 8043 | CCUAGAUGCUGGGGGUAGU | 8044 | CCuAGAUGCUGGGGGuAGUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1789-1808 | 8045 | CUACCCCCAGCAUCUAGGC | 8046 | cuAccccCAGcAucuAGGcdTsdT | sense |
| 1789-1808 | 8047 | GCCUAGAUGCUGGGGGUAG | 8048 | GCCuAGAUGCUGGGGGuAGdTsdT | antis |
| 1791-1810 | 8049 | ACCCCCAGCAUCUAGGCCU | 8050 | AccccCAGcAucuAGGccudTsdT | sense |
| 1791-1810 | 8051 | AGGCCUAGAUGCUGGGGGU | 8052 | AGGCCuAGAUGCUGGGGGUdTsdT | antis |
| 1793-1812 | 8053 | CCCCAGCAUCUAGGCCUCC | 8054 | ccccAGcAucuAGGccuccdTsdT | sense |
| 1793-1812 | 8055 | GGAGGCCUAGAUGCUGGGG | 8056 | GGAGGCCuAGAUGCUGGGGdTsdT | antis |
| 1797-1816 | 8057 | AGCAUCUAGGCCUCCCUCA | 8058 | AGcAucuAGGccucccucAdTsdT | sense |
| 1797-1816 | 8059 | UGAGGGAGGCCUAGAUGCU | 8060 | UGAGGGAGGCCuAGAUGCUdTsdT | antis |
| 1822-1841 | 8061 | UAACCUCUGUGGUGGGCUU | 8062 | uAAccucuGuGGuGGGcuudTsdT | sense |
| 1822-1841 | 8063 | AAGCCCACCACAGAGGUUA | 8064 | AAGCCcACcAcAGAGGUuAdTsdT | antis |
| 1823-1842 | 8065 | AACCUCUGUGGUGGGCUUU | 8066 | AAccucuGuGGuGGGcuuudTsdT | sense |
| 1823-1842 | 8067 | AAAGCCCACCACAGAGGUU | 8068 | AAAGCCcACcAcAGAGGUUdTsdT | antis |
| 1826-1845 | 8069 | CUCUGUGGUGGGCUUUUUA | 8070 | cucuGuGGuGGGcuuuuuAdTsdT | sense |
| 1826-1845 | 8071 | UAAAAAGCCCACCACAGAG | 8072 | uAAAAAGCCcACcAcAGAGdTsdT | antis |
| 1827-1846 | 8073 | UCUGUGGUGGGCUUUUUAA | 8074 | ucuGuGGuGGGcuuuuuAAdTsdT | sense |
| 1827-1846 | 8075 | UUAAAAAGCCCACCACAGA | 8076 | UuAAAAAGCCcACcAcAGAdTsdT | antis |
| 1828-1847 | 8077 | CUGUGGUGGGCUUUUUAAA | 8078 | cuGuGGuGGGcuuuuuAAAdTsdT | sense |
| 1828-1847 | 8079 | UUUAAAAAGCCCACCACAG | 8080 | UUuAAAAAGCCcACcAcAGdTsdT | antis |
| 1829-1848 | 8081 | UGUGGUGGGCUUUUUAAAG | 8082 | uGuGGuGGGcuuuuuAAAGdTsdT | sense |
| 1829-1848 | 8083 | CUUUAAAAAGCCCACCACA | 8084 | CUUuAAAAAGCCcACcAcAdTsdT | antis |
| 1830-1849 | 8085 | GUGGUGGGCUUUUUAAAGA | 8086 | GuGGuGGGcuuuuuAAAGAdTsdT | sense |
| 1830-1849 | 8087 | UCUUUAAAAAGCCCACCAC | 8088 | UCUUuAAAAAGCCcACcACdTsdT | antis |
| 1832-1851 | 8089 | GGUGGGCUUUUUAAAGAGG | 8090 | GGuGGGcuuuuuAAAGAGGdTsdT | sense |
| 1832-1851 | 8091 | CCUCUUUAAAAAGCCCACC | 8092 | CCUCUUuAAAAAGCCcACCdTsdT | antis |
| 1835-1854 | 8093 | GGGCUUUUUAAAGAGGAUU | 8094 | GGGcuuuuuAAAGAGGAuudTsdT | sense |
| 1835-1854 | 8095 | AAUCCUCUUUAAAAAGCCC | 8096 | AAUCCUCUUuAAAAAGCCCdTsdT | antis |
| 1836-1855 | 8097 | GGCUUUUUAAAGAGGAUUU | 8098 | GGcuuuuuAAAGAGGAuuudTsdT | sense |
| 1836-1855 | 8099 | AAAUCCUCUUUAAAAAGCC | 8100 | AAAUCCUCUUuAAAAAGCCdTsdT | antis |
| 1884-1903 | 8101 | AAGGACGGGGUUUGGGGGU | 8102 | AAGGAcGGGGuuuGGGGGudTsdT | sense |
| 1884-1903 | 8103 | ACCCCCAAACCCCGUCCUU | 8104 | ACCCCcAAACCCCGUCCUUdTsdT | antis |
| 1886-1905 | 8105 | GGACGGGGUUUGGGGGUGU | 8106 | GGAcGGGGuuuGGGGGuGudTsdT | sense |
| 1886-1905 | 8107 | ACACCCCCAAACCCCGUCC | 8108 | AcACCCCcAAACCCCGUCCdTsdT | antis |
| 1889-1908 | 8109 | CGGGGUUUGGGGGUGUGAG | 8110 | cGGGGuuuGGGGGuGuGAGdTsdT | sense |
| 1889-1908 | 8111 | CUCACACCCCCAAACCCCG | 8112 | CUcAcACCCCcAAACCCCGdTsdT | antis |
| 1890-1909 | 8113 | GGGGUUUGGGGGUGUGAGG | 8114 | GGGGuuuGGGGGuGuGAGGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1890-1909 | 8115 | CCUCACACCCCCAAACCCC | 8116 | CCUcAcACCCCcAAACCCCdTsdT | antis |
| 1891-1910 | 8117 | GGGUUUGGGGGUGUGAGGA | 8118 | GGGuuuGGGGGuGuGAGGAdTsdT | sense |
| 1891-1910 | 8119 | UCCUCACACCCCCAAACCC | 8120 | UCCUcAcACCCCcAAACCCdTsdT | antis |
| 1892-1911 | 8121 | GGUUUGGGGGUGUGAGGAC | 8122 | GGuuuGGGGGuGuGAGGAcdTsdT | sense |
| 1892-1911 | 8123 | GUCCUCACACCCCCAAACC | 8124 | GUCCUcAcACCCCcAAACCdTsdT | antis |
| 1893-1912 | 8125 | GUUUGGGGGUGUGAGGACC | 8126 | GuuuGGGGGuGuGAGGAccdTsdT | sense |
| 1893-1912 | 8127 | GGUCCUCACACCCCCAAAC | 8128 | GGUCCUcAcACCCCcAAACdTsdT | antis |
| 1894-1913 | 8129 | UUUGGGGGUGUGAGGACCU | 8130 | uuuGGGGGuGuGAGGAccudTsdT | sense |
| 1894-1913 | 8131 | AGGUCCUCACACCCCCAAA | 8132 | AGGUCCUcAcACCCCcAAAdTsdT | antis |
| 1895-1914 | 8133 | UUGGGGGUGUGAGGACCUU | 8134 | uuGGGGGuGuGAGGAccuudTsdT | sense |
| 1895-1914 | 8135 | AAGGUCCUCACACCCCCAA | 8136 | AAGGUCCUcAcACCCCcAAdTsdT | antis |
| 1914-1933 | 8137 | CUACCCCCUUGGUCCCCUC | 8138 | cuAccccuuGGuccccucdTsdT | sense |
| 1914-1933 | 8139 | GAGGGGACCAAGGGGGUAG | 8140 | GAGGGGAcCAAGGGGGuAGdTsdT | antis |
| 1915-1934 | 8141 | UACCCCCUUGGUCCCCUCC | 8142 | uAccccuuGGuccccuccdTsdT | sense |
| 1915-1934 | 8143 | GGAGGGGACCAAGGGGGUA | 8144 | GGAGGGGAcCAAGGGGGuAdTsdT | antis |
| 1916-1935 | 8145 | ACCCCCUUGGUCCCCUCCC | 8146 | AccccuuGGuccccucccdTsdT | sense |
| 1916-1935 | 8147 | GGGAGGGGACCAAGGGGGU | 8148 | GGGAGGGGACcAAGGGGGUdTsdT | antis |
| 1917-1936 | 8149 | CCCCCUUGGUCCCCUCCCC | 8150 | ccccuuGGuccccuccccdTsdT | sense |
| 1917-1936 | 8151 | GGGGAGGGGACCAAGGGGG | 8152 | GGGGAGGGGACcAAGGGGGdTsdT | antis |
| 1918-1937 | 8153 | CCCCUUGGUCCCCUCCCCU | 8154 | ccccuuGGuccccucccccudTsdT | sense |
| 1918-1937 | 8155 | AGGGGAGGGGACCAAGGGG | 8156 | AGGGGAGGGGACcAAGGGGdTsdT | antis |
| 1919-1938 | 8157 | CCCUUGGUCCCCUCCCCUC | 8158 | cccuuGGuccccuccccucdTsdT | sense |
| 1919-1938 | 8159 | GAGGGGAGGGGACCAAGGG | 8160 | GAGGGGAGGGGACcAAGGGdTsdT | antis |
| 1920-1939 | 8161 | CCUUGGUCCCCUCCCCUCC | 8162 | ccuuGGuccccuccccuccdTsdT | sense |
| 1920-1939 | 8163 | GGAGGGGAGGGGACCAAGG | 8164 | GGAGGGGAGGGGACcAAGGdTsdT | antis |
| 1921-1940 | 8165 | CUUGGUCCCCUCCCCUCCC | 8166 | cuuGGuccccuccccucccdTsdT | sense |
| 1921-1940 | 8167 | GGGAGGGGAGGGGACCAAG | 8168 | GGGAGGGGAGGGGACcAAGdTsdT | antis |
| 1922-1941 | 8169 | UUGGUCCCCUCCCCUCCCC | 8170 | uuGGuccccuccccuccccdTsdT | sense |
| 1922-1941 | 8171 | GGGGAGGGGAGGGGACCAA | 8172 | GGGGAGGGGAGGGGACcAAdTsdT | antis |
| 2116-2135 | 8173 | UUCUUGUCCUCUGCUCCCA | 8174 | uucuuGuccucuGcucccAdTsdT | sense |
| 2116-2135 | 8175 | UGGGAGCAGAGGACAAGAA | 8176 | UGGGAGcAGAGGAcAAGAAdTsdT | antis |
| 213-232 | 8177 | GGAGGCGGCCCUGGGGCU | 8178 | GGAGGcGGcccuGGGGcudTsdT | sense |
| 213-232 | 8179 | AGCCCCCAGGGCCGCCUCC | 8180 | AGCCCCcAGGGCCGCCUCCdTsdT | antis |
| 358-377 | 8181 | UGGGUGGGGGCGUGGGAGC | 8182 | uGGGuGGGGGcGuGGGAGcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 358-377 | 8183 | GCUCCCACGCCCCCACCCA | 8184 | GCUCCcACGCCCCcACCcAdTsdT | antis |
| 528-547 | 8185 | CGUUCCCAAGAAGUGGCUU | 8186 | cGuucccAAGAAGuGGcuudTsdT | sense |
| 528-547 | 8187 | AAGCCACUUCUUGGGAACG | 8188 | AAGCcACUUCUUGGGAACGdTsdT | antis |
| 559-578 | 8189 | AAGUGAUUGGUAAUGGCUC | 8190 | AAGuGAuuGGuAAuGGcucdTsdT | sense |
| 559-578 | 8191 | GAGCCAUUACCAAUCACUU | 8192 | GAGCcAUuACcAAUcACUUdTsdT | antis |
| 623-642 | 8193 | GGUGGCCAUCAAGAAGGUU | 8194 | GGuGGccAucAAGAAGGuudTsdT | sense |
| 623-642 | 8195 | AACCUUCUUGAUGGCCACC | 8196 | AACCUUCUUGAUGGCcACCdTsdT | antis |
| 630-649 | 8197 | AUCAAGAAGGUUCUUCAGG | 8198 | AucAAGAAGGuucuucAGGdTsdT | sense |
| 630-649 | 8199 | CCUGAAGAACCUUCUUGAU | 8200 | CCUGAAGAACCUUCUUGAUdTsdT | antis |
| 633-652 | 8201 | AAGAAGGUUCUUCAGGACA | 8202 | AAGAAGGuucuucAGGAcAdTsdT | sense |
| 633-652 | 8203 | UGUCCUGAAGAACCUUCUU | 8204 | UGUCCUGAAGAACCUUCUUdTsdT | antis |
| 801-820 | 8205 | CGAGUGGCCCGCCACUUCA | 8206 | cGAGuGGcccGccAcuucAdTsdT | sense |
| 801-820 | 8207 | UGAAGUGGCGGGCCACUCG | 8208 | UGAAGUGGCGGGCcACUCGdTsdT | antis |
| 859-878 | 8209 | UGUACAUGUACCAGCUCUU | 8210 | uGuAcAuGuAccAGcucuudTsdT | sense |
| 859-878 | 8211 | AAGAGCUGGUACAUGUACA | 8212 | AAGAGCUGGuAcAUGuAcAdTsdT | antis |
| 936-955 | 8213 | AAUUUGCUUGUGGACCCUG | 8214 | AAuuuGcuuGuGGAcccuGdTsdT | sense |
| 936-955 | 8215 | CAGGGUCCACAAGCAAAUU | 8216 | cAGGGUCcAcAAGcAAAUUdTsdT | antis |
| 944-963 | 8217 | UGUGGACCCUGACACUGCU | 8218 | uGuGGAcccuGAcAcuGcudTsdT | sense |
| 944-963 | 8219 | AGCAGUGUCAGGGUCCACA | 8220 | AGcAGUGUcAGGGUCcAcAdTsdT | antis |
| 960-979 | 8221 | GCUGUCCUCAAGCUCUGCG | 8222 | GcuGuccucAAGcucuGcGdTsdT | sense |
| 960-979 | 8223 | CGCAGAGCUUGAGGACAGC | 8224 | CGcAGAGCUUGAGGAcAGCdTsdT | antis |
| 966-985 | 8225 | CUCAAGCUCUGCGAUUUUG | 8226 | cucAAGcucuGcGAuuuuGdTsdT | sense |
| 966-985 | 8227 | CAAAAUCGCAGAGCUUGAG | 8228 | cAAAAUCGcAGAGCUUGAGdTsdT | antis |
| 982-1001 | 8229 | UUGGCAGUGCAAAGCAGCU | 8230 | uuGGcAGuGcAAAGcAGcudTsdT | sense |
| 982-1001 | 8231 | AGCUGCUUUGCACUGCCAA | 8232 | AGCUGCUUUGcACUGCcAAdTsdT | antis |
| 983-1002 | 8233 | UGGCAGUGCAAAGCAGCUG | 8234 | uGGcAGuGcAAAGcAGcuGdTsdT | sense |
| 983-1002 | 8235 | CAGCUGCUUUGCACUGCCA | 8236 | cAGCUGCUUUGcACUGCcAdTsdT | antis |
| 1170-1189 | 8237 | GACCAGCUUGUGGAGAUCA | 8238 | GAccAGcuuGuGGAGAucAdTsdT | sense |
| 1170-1189 | 8239 | UGAUCUCCACAAGCUGGUC | 8240 | UGAUCUCcAcAAGCUGGUCdTsdT | antis |
| 1210-1229 | 8241 | CCAGGGAACAAAUCCGAGA | 8242 | ccAGGGAcAAAuccGAGAdTsdT | sense |
| 1210-1229 | 8243 | UCUCGGAUUUGUUCCCUGG | 8244 | UCUCGGAUUUGUUCCCUGGdTsdT | antis |
| 1521-1540 | 8245 | CCUCACUUGAGGUCCCCAG | 8246 | ccucAcuuGAGGuccccAGdTsdT | sense |
| 1521-1540 | 8247 | CUGGGGACCUCAAGUGAGG | 8248 | CUGGGGACCUcAAGUGAGGdTsdT | antis |
| 1533-1552 | 8249 | UCCCAGCAGGCCCUGCUU | 8250 | ucccAGcAGGcccuGcuudTsdT | sense |
| 1533-1552 | 8251 | AAGCAGGGCCUGCUGGGGA | 8252 | AAGcAGGGCCUGCUGGGGAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1534-1553 | 8253 | CCCCAGCAGGCCCUGCUUC | 8254 | ccccAGcAGGcccuGcuucdTsdT | sense |
| 1534-1553 | 8255 | GAAGCAGGGCCUGCUGGGG | 8256 | GAAGcAGGGCCUGCUGGGGdTsdT | antis |
| 1679-1698 | 8257 | ACCCCUCCACGUCCAUCUG | 8258 | AccccuccAcGuccAucuGdTsdT | sense |
| 1679-1698 | 8259 | CAGAUGGACGUGGAGGGGU | 8260 | cAGAUGGACGUGGAGGGGUdTsdT | antis |
| 1680-1699 | 8261 | CCCCUCCACGUCCAUCUGG | 8262 | ccccuccAcGuccAucuGGdTsdT | sense |
| 1680-1699 | 8263 | CCAGAUGGACGUGGAGGGG | 8264 | CcAGAUGGACGUGGAGGGGdTsdT | antis |
| 1684-1703 | 8265 | UCCACGUCCAUCUGGGAAG | 8266 | uccAcGuccAucuGGGAAGdTsdT | sense |
| 1684-1703 | 8267 | CUUCCCAGAUGGACGUGGA | 8268 | CUUCCcAGAUGGACGUGGAdTsdT | antis |
| 1710-1729 | 8269 | UGGCGCUGGGAAGGGGGCC | 8270 | uGGcGcuGGGAAGGGGccdTsdT | sense |
| 1710-1729 | 8271 | GGCCCCCUUCCCAGCGCCA | 8272 | GGCCCCCUUCCcAGCGCcAdTsdT | antis |
| 1711-1730 | 8273 | GGCGCUGGGAAGGGGGCCA | 8274 | GGcGcuGGGAAGGGGGccAdTsdT | sense |
| 1711-1730 | 8275 | UGGCCCCCUUCCCAGCGCC | 8276 | UGGCCCCCUUCCcAGCGCCdTsdT | antis |
| 1726-1745 | 8277 | GCCACAGCCCAUCAAGCUC | 8278 | GccAcAGcccAucAAGcucdTsdT | sense |
| 1726-1745 | 8279 | GAGCUUGAUGGGCUGUGGC | 8280 | GAGCUUGAUGGGCUGUGGCdTsdT | antis |
| 1731-1750 | 8281 | AGCCCAUCAAGCUCCUGCC | 8282 | AGcccAucAAGcuccuGccdTsdT | sense |
| 1731-1750 | 8283 | GGCAGGAGCUUGAUGGGCU | 8284 | GGcAGGAGCUUGAUGGGCUdTsdT | antis |
| 1740-1759 | 8285 | AGCUCCUGCCCUGGCUGGG | 8286 | AGcuccuGcccuGGcuGGGdTsdT | sense |
| 1740-1759 | 8287 | CCCAGCCAGGGCAGGAGCU | 8288 | CCcAGCcAGGGcAGGAGCUdTsdT | antis |
| 1741-1760 | 8289 | GCUCCUGCCCUGGCUGGGC | 8290 | GcuccuGcccuGGcuGGGcdTsdT | sense |
| 1741-1760 | 8291 | GCCCAGCCAGGGCAGGAGC | 8292 | GCCcAGCcAGGGcAGGAGCdTsdT | antis |
| 1767-1786 | 8293 | CUAGAGGGCAGAGGUAAAU | 8294 | cuAGAGGGcAGAGGuAAAudTsdT | sense |
| 1767-1786 | 8295 | AUUUACCUCUGCCCUCUAG | 8296 | AUUuACCUCUGCCCUCuAGdTsdT | antis |
| 1772-1791 | 8297 | GGGCAGAGGUAAAUGAACU | 8298 | GGGcAGAGGuAAAuGAAcudTsdT | sense |
| 1772-1791 | 8299 | AGUUCAUUUACCUCUGCCC | 8300 | AGUUcAUUuACCUCUGCCCdTsdT | antis |
| 1775-1794 | 8301 | CAGAGGUAAAUGAACUACC | 8302 | cAGAGGuAAAuGAAcuAccdTsdT | sense |
| 1775-1794 | 8303 | GGUAGUUCAUUUACCUCUG | 8304 | GGuAGUUcAUUuACCUCUGdTsdT | antis |
| 1824-1843 | 8305 | ACCUCUGUGGUGGGCUUUU | 8306 | AccucuGuGGuGGGcuuuudTsdT | sense |
| 1824-1843 | 8307 | AAAAGCCCACCACAGAGGU | 8308 | AAAAGCCcACcAcAGAGGUdTsdT | antis |
| 1834-1853 | 8309 | UGGGCUUUUUAAAAGAGGAU | 8310 | uGGGcuuuuuAAAAGAGGAudTsdT | sense |
| 1834-1853 | 8311 | AUCCUCUUUAAAAAGCCCA | 8312 | AUCCUCUUuAAAAAGCCcAdTsdT | antis |
| 2015-2034 | 8313 | UUCCCUUCCCUGGCCCCCU | 8314 | uucccuucccuGGccccudTsdT | sense |
| 2015-2034 | 8315 | AGGGGGCCAGGGAAGGGAA | 8316 | AGGGGGCcAGGGAAGGGAAdTsdT | antis |
| 69-88 | 8317 | GGAGCCGGAGCCCGAACGG | 8318 | GGAGccGGAGcccGAAcGGdTsdT | sense |
| 69-88 | 8319 | CCGUUCGGGCUCCGGCUCC | 8320 | CCGUUCGGGCUCCGGCUCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 112-131 | 8321 | CAGGGGAGGCGGCGGCAGA | 8322 | cAGGGGAGGcGGcGGcAGAdTsdT | sense |
| 112-131 | 8323 | UCUGCCGCCGCCUCCCCUG | 8324 | UCUGCCGCCGCCUCCCCUGdTsdT | antis |
| 113-132 | 8325 | AGGGGAGGCGGCGGCAGAG | 8326 | AGGGGAGGcGGcGGcAGAGdTsdT | sense |
| 113-132 | 8327 | CUCUGCCGCCGCCUCCCCU | 8328 | CUCUGCCGCCGCCUCCCCUdTsdT | antis |
| 114-133 | 8329 | GGGGAGGCGGCGGCAGAGG | 8330 | GGGGAGGcGGcGGcAGAGGdTsdT | sense |
| 114-133 | 8331 | CCUCUGCCGCCGCCUCCCC | 8332 | CCUCUGCCGCCGCCUCCCCdTsdT | antis |
| 116-135 | 8333 | GGAGGCGGCGGCAGAGGCA | 8334 | GGAGGcGGcGGcAGAGGcAdTsdT | sense |
| 116-135 | 8335 | UGCCUCUGCCGCCGCCUCC | 8336 | UGCCUCUGCCGCCGCCUCCdTsdT | antis |
| 130-149 | 8337 | AGGCAGCGGCGGGGGCAGC | 8338 | AGGcAGcGGcGGGGGcAGcdTsdT | sense |
| 130-149 | 8339 | GCUGCCCCCGCCGCUGCCU | 8340 | GCUGCCCCCGCCGCUGCCUdTsdT | antis |
| 131-150 | 8341 | GGCAGCGGCGGGGGCAGCC | 8342 | GGcAGcGGcGGGGGcAGccdTsdT | sense |
| 131-150 | 8343 | GGCUGCCCCCGCCGCUGCC | 8344 | GGCUGCCCCCGCCGCUGCCdTsdT | antis |
| 166-185 | 8345 | CGCGGCCUGGGCCUGCGCU | 8346 | cGcGGccuGGGccuGcGcudTsdT | sense |
| 166-185 | 8347 | AGCGCAGGCCCAGGCCGCG | 8348 | AGCGcAGGCCcAGGCCGCGdTsdT | antis |
| 272-291 | 8349 | CGGAGGCGGAGGUGGUGGC | 8350 | cGGAGGcGGAGGuGGuGGcdTsdT | sense |
| 272-291 | 8351 | GCCACCACCUCCGCCUCCG | 8352 | GCcAccACCUCCGCCUCCGdTsdT | antis |
| 273-292 | 8353 | GGAGGCGGAGGUGGUGGCG | 8354 | GGAGGcGGAGGuGGuGGcGdTsdT | sense |
| 273-292 | 8355 | CGCCACCACCUCCGCCUCC | 8356 | CGCcAccACCUCCGCCUCCdTsdT | antis |
| 274-293 | 8357 | GAGGCGGAGGUGGUGGCGG | 8358 | GAGGcGGAGGuGGuGGcGGdTsdT | sense |
| 274-293 | 8359 | CCGCCACCACCUCCGCCUC | 8360 | CCGCcAccACCUCCGCCUCdTsdT | antis |
| 276-295 | 8361 | GGCGGAGGUGGUGGCGGCG | 8362 | GGcGGAGGuGGuGGcGGcGdTsdT | sense |
| 276-295 | 8363 | CGCCGCCACCACCUCCGCC | 8364 | CGCCGCcAccACCUCCGCCdTsdT | antis |
| 277-296 | 8365 | GCGGAGGUGGUGGCGGCGG | 8366 | GcGGAGGuGGuGGcGGcGGdTsdT | sense |
| 277-296 | 8367 | CCGCCGCCACCACCUCCGC | 8368 | CCGCCGCcAccACCUCCGCdTsdT | antis |
| 285-304 | 8369 | GGUGGCGGCGGCCCCGGGG | 8370 | GGuGGcGGcGGccccGGGGdTsdT | sense |
| 285-304 | 8371 | CCCCGGGGCCGCCGCCACC | 8372 | CCCCGGGGCCGCCGCcACCdTsdT | antis |
| 286-305 | 8373 | GUGGCGGCGGCCCCGGGGG | 8374 | GuGGcGGcGGccccGGGGGdTsdT | sense |
| 286-305 | 8375 | CCCCCGGGGCCGCCGCCAC | 8376 | CCCCCGGGGCCGCCGCcACdTsdT | antis |
| 287-306 | 8377 | UGGCGGCGGCCCCGGGGGC | 8378 | uGGcGGcGGccccGGGGGcdTsdT | sense |
| 287-306 | 8379 | GCCCCCGGGGCCGCCGCCA | 8380 | GCCCCCGGGGCCGCCGCcAdTsdT | antis |
| 288-307 | 8381 | GGCGGCGGCCCCGGGGGCU | 8382 | GGcGGcGGccccGGGGGcudTsdT | sense |
| 288-307 | 8383 | AGCCCCGGGGCCGCCGCCC | 8384 | AGCCCCGGGGCCGCCGCCCdTsdT | antis |
| 309-328 | 8385 | GCCUCUGGCCCAGGAGGCA | 8386 | GccucuGGcccAGGAGGcAdTsdT | sense |
| 309-328 | 8387 | UGCCUCCUGGGCCAGAGGC | 8388 | UGCCUCCUGGGCcAGAGGCdTsdT | antis |
| 310-329 | 8389 | CCUCUGGCCCAGGAGGCAC | 8390 | ccucuGGcccAGGAGGcAcdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 310-329 | 8391 | GUGCCUCCUGGGCCAGAGG | 8392 | GUGCCUCCUGGGCcAGAGGdTsdT | antis |
| 312-331 | 8393 | UCUGGCCCAGGAGGCACUG | 8394 | ucuGGcccAGGAGGcAcuGdTsdT | sense |
| 312-331 | 8395 | CAGUGCCUCCUGGGCCAGA | 8396 | cAGUGCCUCCUGGGCcAGAdTsdT | antis |
| 313-332 | 8397 | CUGGCCCAGGAGGCACUGG | 8398 | cuGGcccAGGAGGcAcuGGdTsdT | sense |
| 313-332 | 8399 | CCAGUGCCUCCUGGGCCAG | 8400 | CcAGUGCCUCCUGGGCcAGdTsdT | antis |
| 315-334 | 8401 | GGCCCAGGAGGCACUGGCG | 8402 | GGcccAGGAGGcAcuGGcGdTsdT | sense |
| 315-334 | 8403 | CGCCAGUGCCUCCUGGGCC | 8404 | CGCcAGUGCCUCCUGGGCCdTsdT | antis |
| 356-375 | 8405 | UAUGGGUGGGGGCGUGGGA | 8406 | uAuGGGuGGGGGcGuGGGAdTsdT | sense |
| 356-375 | 8407 | UCCCACGCCCCCACCCAUA | 8408 | UCCcACGCCCCcACCcAuAdTsdT | antis |
| 359-378 | 8409 | GGGUGGGGGCGUGGGAGCC | 8410 | GGGuGGGGGcGuGGGAGccdTsdT | sense |
| 359-378 | 8411 | GGCUCCCACGCCCCCACCC | 8412 | GGCUCCcACGCCCCcACCCdTsdT | antis |
| 360-379 | 8413 | GGUGGGGGCGUGGGAGCCU | 8414 | GGuGGGGGcGuGGGAGccudTsdT | sense |
| 360-379 | 8415 | AGGCUCCCACGCCCCCACC | 8416 | AGGCUCCcACGCCCCcACCdTsdT | antis |
| 362-381 | 8417 | UGGGGGCGUGGGAGCCUCG | 8418 | uGGGGGcGuGGGAGccucGdTsdT | sense |
| 362-381 | 8419 | CGAGGCUCCCACGCCCCCA | 8420 | CGAGGCUCCcACGCCCCcAdTsdT | antis |
| 367-386 | 8421 | GCGUGGGAGCCUCGAGCUC | 8422 | GcGuGGGAGccucGAGcucdTsdT | sense |
| 367-386 | 8423 | GAGCUCGAGGCUCCCACGC | 8424 | GAGCUCGAGGCUCCcACGCdTsdT | antis |
| 401-420 | 8425 | CGGCAGCGGCGGAGGAGGC | 8426 | cGGcAGcGGcGGAGGAGGcdTsdT | sense |
| 401-420 | 8427 | GCCUCCUCCGCCGCUGCCG | 8428 | GCCUCCUCCGCCGCUGCCGdTsdT | antis |
| 402-421 | 8429 | GGCAGCGGCGGAGGAGGCA | 8430 | GGcAGcGGcGGAGGAGGcAdTsdT | sense |
| 402-421 | 8431 | UGCCUCCUCCGCCGCUGCC | 8432 | UGCCUCCUCCGCCGCUGCCdTsdT | antis |
| 409-428 | 8433 | GCGGAGGAGGCAGCGGUGG | 8434 | GcGGAGGAGGcAGcGGuGGdTsdT | sense |
| 409-428 | 8435 | CCACCGCUGCCUCCUCCGC | 8436 | CcACCGCUGCCUCCUCCGCdTsdT | antis |
| 410-429 | 8437 | CGGAGGAGGCAGCGGUGGC | 8438 | cGGAGGAGGcAGcGGuGGcdTsdT | sense |
| 410-429 | 8439 | GCCACCGCUGCCUCCUCCG | 8440 | GCcACCGCUGCCUCCUCCGdTsdT | antis |
| 415-434 | 8441 | GAGGCAGCGGUGGCCCCGG | 8442 | GAGGcAGcGGuGGccccGGdTsdT | sense |
| 415-434 | 8443 | CCGGGGCCACCGCUGCCUC | 8444 | CCGGGGCcACCGCUGCCUCdTsdT | antis |
| 416-435 | 8445 | AGGCAGCGGUGGCCCCGGC | 8446 | AGGcAGcGGuGGccccGGcdTsdT | sense |
| 416-435 | 8447 | GCCGGGGCCACCGCUGCCU | 8448 | GCCGGGGCcACCGCUGCCUdTsdT | antis |
| 483-502 | 8449 | GGGAAGGUGACCACAGUGG | 8450 | GGGAAGGuGAccAcAGuGGdTsdT | sense |
| 483-502 | 8451 | CCACUGUGGUCACCUUCCC | 8452 | CcACUGUGGUcACCUUCCCdTsdT | antis |
| 484-503 | 8453 | GGAAGGUGACCACAGUGGU | 8454 | GGAAGGuGAccAcAGuGGudTsdT | sense |
| 484-503 | 8455 | ACCACUGUGGUCACCUUCC | 8456 | AccACUGUGGUcACCUUCCdTsdT | antis |
| 486-505 | 8457 | AAGGUGACCACAGUGGUAG | 8458 | AAGGuGAccAcAGuGGuAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 486-505 | 8459 | CUACCACUGUGGUCACCUU | 8460 | CuACcACUGUGGUcACCUUdTsdT | antis |
| 529-548 | 8461 | GUUCCCAAGAAGUGGCUUA | 8462 | GuucccAAGAAGuGGcuuAdTsdT | sense |
| 529-548 | 8463 | UAAGCCACUUCUUGGGAAC | 8464 | uAAGCcACUUCUUGGGAACdTsdT | antis |
| 560-579 | 8465 | AGUGAUUGGUAAUGGCUCA | 8466 | AGuGAuuGGuAAuGGcucAdTsdT | sense |
| 560-579 | 8467 | UGAGCCAUUACCAAUCACU | 8468 | UGAGCcAUuACcAAUcACUdTsdT | antis |
| 561-580 | 8469 | GUGAUUGGUAAUGGCUCAU | 8470 | GuGAuuGGuAAuGGcucAudTsdT | sense |
| 561-580 | 8471 | AUGAGCCAUUACCAAUCAC | 8472 | AUGAGCcAUuACcAAUcACdTsdT | antis |
| 622-641 | 8473 | UGGUGGCCAUCAAGAAGGU | 8474 | uGGuGGccAucAAGAAGGudTsdT | sense |
| 622-641 | 8475 | ACCUUCUUGAUGGCCACCA | 8476 | ACCUUCUUGAUGGCcACcAdTsdT | antis |
| 628-647 | 8477 | CCAUCAAGAAGGUUCUUCA | 8478 | ccAucAAGAAGGuucuucAdTsdT | sense |
| 628-647 | 8479 | UGAAGAACCUUCUUGAUGG | 8480 | UGAAGAACCUUCUUGAUGGdTsdT | antis |
| 629-648 | 8481 | CAUCAAGAAGGUUCUUCAG | 8482 | cAucAAGAAGGuucuucAGdTsdT | sense |
| 629-648 | 8483 | CUGAAGAACCUUCUUGAUG | 8484 | CUGAAGAACCUUCUUGAUGdTsdT | antis |
| 637-656 | 8485 | AGGUUCUUCAGGACAAAAG | 8486 | AGGuucuucAGGAcAAAAGdTsdT | sense |
| 637-656 | 8487 | CUUUUGUCCUGAAGAACCU | 8488 | CUUUUGUCCUGAAGAACCUdTsdT | antis |
| 684-703 | 8489 | CGUAAGCUGGACCACUGCA | 8490 | cGuAAGcuGGAccAcuGcAdTsdT | sense |
| 684-703 | 8491 | UGCAGUGGUCCAGCUUACG | 8492 | UGcAGUGGUCcAGCUuACGdTsdT | antis |
| 695-714 | 8493 | CCACUGCAAUAUUGUGAGG | 8494 | ccAcuGcAAuAuuGuGAGGdTsdT | sense |
| 695-714 | 8495 | CCUCACAAUAUUGCAGUGG | 8496 | CCUcAcAAuAUUGcAGUGGdTsdT | antis |
| 719-738 | 8497 | GUACUUUUUCUACUCCAGU | 8498 | GuAcuuuuucuAcuccAGudTsdT | sense |
| 719-738 | 8499 | ACUGGAGUAGAAAAAGUAC | 8500 | ACUGGAGuAGAAAAAGuACdTsdT | antis |
| 722-741 | 8501 | CUUUUUCUACUCCAGUGGG | 8502 | cuuuuucuAcuccAGuGGGdTsdT | sense |
| 722-741 | 8503 | CCCACUGGAGUAGAAAAAG | 8504 | CCcACUGGAGuAGAAAAAGdTsdT | antis |
| 728-747 | 8505 | CUACUCCAGUGGGGAGAAG | 8506 | cuAcuccAGuGGGGAGAAGdTsdT | sense |
| 728-747 | 8507 | CUUCUCCCCACUGGAGUAG | 8508 | CUUCUCCCcACUGGAGuAGdTsdT | antis |
| 732-751 | 8509 | UCCAGUGGGGAGAAGAAGG | 8510 | uccAGuGGGGAGAAGAAGGdTsdT | sense |
| 732-751 | 8511 | CCUUCUUCUCCCCACUGGA | 8512 | CCUUCUUCUCCCcACUGGAdTsdT | antis |
| 734-753 | 8513 | CAGUGGGGAGAAGAAGGAC | 8514 | cAGuGGGGAGAAGAAGGAcdTsdT | sense |
| 734-753 | 8515 | GUCCUUCUUCUCCCCACUG | 8516 | GUCCUUCUUCUCCCcACUGdTsdT | antis |
| 735-754 | 8517 | AGUGGGGAGAAGAAGGACG | 8518 | AGuGGGGAGAAGAAGGAcGdTsdT | sense |
| 735-754 | 8519 | CGUCCUUCUUCUCCCCACU | 8520 | CGUCCUUCUUCUCCCcACUdTsdT | antis |
| 766-785 | 8521 | AUCUGGUGCUGGAGUAUGU | 8522 | AucuGGuGcuGGAGuAuGudTsdT | sense |
| 766-785 | 8523 | ACAUACUCCAGCACCAGAU | 8524 | AcAuACUCcAGcACcAGAUdTsdT | antis |
| 767-786 | 8525 | UCUGGUGCUGGAGUAUGUG | 8526 | ucuGGuGcuGGAGuAuGuGdTsdT | sense |
| 767-786 | 8527 | CACAUACUCCAGCACCAGA | 8528 | cAcAuACUCcAGcACcAGAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 768-787 | 8529 | CUGGUGCUGGAGUAUGUGC | 8530 | cuGGuGcuGGAGuAuGuGcdTsdT | sense |
| 768-787 | 8531 | GCACAUACUCCAGCACCAG | 8532 | GcAcAuACUCcAGcACcAGdTsdT | antis |
| 812-831 | 8533 | CCACUUCACCAAGGCCAAG | 8534 | ccAcuucAccAAGGccAAGdTsdT | sense |
| 812-831 | 8535 | CUUGGCCUUGGUGAAGUGG | 8536 | CUUGGCCUUGGUGAAGUGGdTsdT | antis |
| 814-833 | 8537 | ACUUCACCAAGGCCAAGCU | 8538 | AcuucAccAAGGccAAGcudTsdT | sense |
| 814-833 | 8539 | AGCUUGGCCUUGGUGAAGU | 8540 | AGCUUGGCCUUGGUGAAGUdTsdT | antis |
| 816-835 | 8541 | UUCACCAAGGCCAAGCUGA | 8542 | uucAccAAGGccAAGcuGAdTsdT | sense |
| 816-835 | 8543 | UCAGCUUGGCCUUGGUGAA | 8544 | UcAGCUUGGCCUUGGUGAAdTsdT | antis |
| 819-838 | 8545 | ACCAAGGCCAAGCUGAUCA | 8546 | AccAAGGccAAGcuGAucAdTsdT | sense |
| 819-838 | 8547 | UGAUCAGCUUGGCCUUGGU | 8548 | UGAUcAGCUUGGCCUUGGUdTsdT | antis |
| 820-839 | 8549 | CCAAGGCCAAGCUGAUCAC | 8550 | ccAAGGccAAGcuGAucAcdTsdT | sense |
| 820-839 | 8551 | GUGAUCAGCUUGGCCUUGG | 8552 | GUGAUcAGCUUGGCCUUGGdTsdT | antis |
| 864-883 | 8553 | AUGUACCAGCUCUUCCGGA | 8554 | AuGuAccAGcucuuccGGAdTsdT | sense |
| 864-883 | 8555 | UCCGGAAGAGCUGGUACAU | 8556 | UCCGGAAGAGCUGGuAcAUdTsdT | antis |
| 875-894 | 8557 | CUUCCGGAGCUUGGCCUAC | 8558 | cuuccGGAGcuuGGccuAcdTsdT | sense |
| 875-894 | 8559 | GUAGGCCAAGCUCCGGAAG | 8560 | GuAGGCcAAGCUCCGGAAGdTsdT | antis |
| 964-983 | 8561 | UCCUCAAGCUCUGCGAUUU | 8562 | uccucAAGcucuGcGAuuudTsdT | sense |
| 964-983 | 8563 | AAAUCGCAGAGCUUGAGGA | 8564 | AAAUCGcAGAGCUUGAGGAdTsdT | antis |
| 965-984 | 8565 | CCUCAAGCUCUGCGAUUUU | 8566 | ccucAAGcucuGcGAuuuudTsdT | sense |
| 965-984 | 8567 | AAAAUCGCAGAGCUUGAGG | 8568 | AAAAUCGcAGAGCUUGAGGdTsdT | antis |
| 969-988 | 8569 | AAGCUCUGCGAUUUUGGCA | 8570 | AAGcucuGcGAuuuuGGcAdTsdT | sense |
| 969-988 | 8571 | UGCCAAAAUCGCAGAGCUU | 8572 | UGCcAAAAUCGcAGAGCUUdTsdT | antis |
| 980-999 | 8573 | UUUUGGCAGUGCAAAGCAG | 8574 | uuuuGGcAGuGcAAAGcAGdTsdT | sense |
| 980-999 | 8575 | CUGCUUUGCACUGCCAAAA | 8576 | CUGCUUUGcACUGCcAAAAdTsdT | antis |
| 981-1000 | 8577 | UUUGGCAGUGCAAAGCAGC | 8578 | uuuGGcAGuGcAAAGcAGcdTsdT | sense |
| 981-1000 | 8579 | GCUGCUUUGCACUGCCAAA | 8580 | GCUGCUUUGcACUGCcAAAdTsdT | antis |
| 985-1004 | 8581 | GCAGUGCAAAGCAGCUGGU | 8582 | GcAGuGcAAAGcAGcuGGudTsdT | sense |
| 985-1004 | 8583 | ACCAGCUGCUUUGCACUGC | 8584 | ACcAGCUGCUUUGcACUGCdTsdT | antis |
| 1166-1185 | 8585 | GGUGGACCAGCUUGUGGAG | 8586 | GGuGGAccAGcuuGuGGAGdTsdT | sense |
| 1166-1185 | 8587 | CUCCACAAGCUGGUCCACC | 8588 | CUCcAcAAGCUGGUCcACCdTsdT | antis |
| 1167-1186 | 8589 | GUGGACCAGCUUGUGGAGA | 8590 | GuGGAccAGcuuGuGGAGAdTsdT | sense |
| 1167-1186 | 8591 | UCUCCACAAGCUGGUCCAC | 8592 | UCUCcAcAAGCUGGUCcACdTsdT | antis |
| 1171-1190 | 8593 | ACCAGCUUGUGGAGAUCAU | 8594 | AccAGcuuGuGGAGAucAudTsdT | sense |
| 1171-1190 | 8595 | AUGAUCUCCACAAGCUGGU | 8596 | AUGAUCUCcAcAAGCUGGUdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1211-1230 | 8597 | CAGGGAACAAAUCCGAGAG | 8598 | cAGGGAAcAAAuccGAGAGdTsdT | sense |
| 1211-1230 | 8599 | CUCUCGGAUUUGUUCCCUG | 8600 | CUCUCGGAUUUGUUCCCUGdTsdT | antis |
| 1254-1273 | 8601 | AAGUUCCCCCAGAUCAAAG | 8602 | AAGuuccccCAGAucAAAGdTsdT | sense |
| 1254-1273 | 8603 | CUUUGAUCUGGGGGAACUU | 8604 | CUUUGAUCUGGGGGAACUUdTsdT | antis |
| 1259-1278 | 8605 | CCCCCAGAUCAAAGCUCAC | 8606 | cccccAGAucAAAGcucAcdTsdT | sense |
| 1259-1278 | 8607 | GUGAGCUUUGAUCUGGGGG | 8608 | GUGAGCUUUGAUCUGGGGGdTsdT | antis |
| 1260-1279 | 8609 | CCCCAGAUCAAAGCUCACC | 8610 | ccccAGAucAAAGcucAccdTsdT | sense |
| 1260-1279 | 8611 | GGUGAGCUUUGAUCUGGGG | 8612 | GGUGAGCUUUGAUCUGGGGdTsdT | antis |
| 1281-1300 | 8613 | UGGACAAAGGUGUUCAAAU | 8614 | uGGAcAAAGGuGuucAAAudTsdT | sense |
| 1281-1300 | 8615 | AUUUGAACACCUUUGUCCA | 8616 | AUUUGAAcACCUUUGUCcAdTsdT | antis |
| 1360-1379 | 8617 | CCUCAAGGCUCUCCCCACU | 8618 | ccucAAGGcucuccccAcudTsdT | sense |
| 1360-1379 | 8619 | AGUGGGGAGAGCCUUGAGG | 8620 | AGUGGGGAGAGCCUUGAGGdTsdT | antis |
| 1381-1400 | 8621 | AGGCUUGUGCCCACAGCUU | 8622 | AGGcuuGuGcccAcAGcuudTsdT | sense |
| 1381-1400 | 8623 | AAGCUGUGGGCACAAGCCU | 8624 | AAGCUGUGGGcAcAAGCCUdTsdT | antis |
| 1385-1404 | 8625 | UUGUGCCCACAGCUUCUUC | 8626 | uuGuGcccAcAGcuucuucdTsdT | sense |
| 1385-1404 | 8627 | GAAGAAGCUGUGGGCACAA | 8628 | GAAGAAGCUGUGGGcAcAAdTsdT | antis |
| 1387-1406 | 8629 | GUGCCCACAGCUUCUUCGA | 8630 | GuGcccAcAGcuucuucGAdTsdT | sense |
| 1387-1406 | 8631 | UCGAAGAAGCUGUGGGCAC | 8632 | UCGAAGAAGCUGUGGGcACdTsdT | antis |
| 1388-1407 | 8633 | UGCCCACAGCUUCUUCGAU | 8634 | uGcccAcAGcuucuucGAudTsdT | sense |
| 1388-1407 | 8635 | AUCGAAGAAGCUGUGGGCA | 8636 | AUCGAAGAAGCUGUGGGcAdTsdT | antis |
| 1455-1474 | 8637 | CCCCUGUUCAACUUCAGUC | 8638 | ccccuGuucAAcuucAGucdTsdT | sense |
| 1455-1474 | 8639 | GACUGAAGUUGAACAGGGG | 8640 | GACUGAAGUUGAAcAGGGGdTsdT | antis |
| 1456-1475 | 8641 | CCCUGUUCAACUUCAGUCC | 8642 | cccuGuucAAcuucAGuccdTsdT | sense |
| 1456-1475 | 8643 | GGACUGAAGUUGAACAGGG | 8644 | GGACUGAAGUUGAAcAGGGdTsdT | antis |
| 1457-1476 | 8645 | CCUGUUCAACUUCAGUCCU | 8646 | ccuGuucAAcuucAGuccudTsdT | sense |
| 1457-1476 | 8647 | AGGACUGAAGUUGAACAGG | 8648 | AGGACUGAAGUUGAAcAGGdTsdT | antis |
| 1458-1477 | 8649 | CUGUUCAACUUCAGUCCUG | 8650 | cuGuucAAcuucAGuccuGdTsdT | sense |
| 1458-1477 | 8651 | CAGGACUGAAGUUGAACAG | 8652 | cAGGACUGAAGUUGAAcAGdTsdT | antis |
| 1513-1532 | 8653 | UCAUCCCUCCUCACUUGAG | 8654 | ucAucccuccucAcuuGAGdTsdT | sense |
| 1513-1532 | 8655 | CUCAAGUGAGGAGGGAUGA | 8656 | CUcAAGUGAGGAGGGAUGAdTsdT | antis |
| 1514-1533 | 8657 | CAUCCCUCCUCACUUGAGG | 8658 | cAucccuccucAcuuGAGGdTsdT | sense |
| 1514-1533 | 8659 | CCUCAAGUGAGGAGGGAUG | 8660 | CCUcAAGUGAGGAGGGAUGdTsdT | antis |
| 1517-1536 | 8661 | CCCUCCUCACUUGAGGUCC | 8662 | cccuccucAcuuGAGGuccdTsdT | sense |
| 1517-1536 | 8663 | GGACCUCAAGUGAGGAGGG | 8664 | GGACCUcAAGUGAGGAGGGdTsdT | antis |
| 1518-1537 | 8665 | CCUCCUCACUUGAGGUCCC | 8666 | ccuccucAcuuGAGGucccdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1518-1537 | 8667 | GGGACCUCAAGUGAGGAGG | 8668 | GGGACCUcAAGUGAGGAGGdTsdT | antis |
| 1519-1538 | 8669 | CUCCUCACUUGAGGUCCCC | 8670 | cuccucAcuuGAGGuccccdTsdT | sense |
| 1519-1538 | 8671 | GGGGACCUCAAGUGAGGAG | 8672 | GGGGACCUcAAGUGAGGAGdTsdT | antis |
| 1525-1544 | 8673 | ACUUGAGGUCCCCAGCAGG | 8674 | AcuuGAGGuccccAGcAGGdTsdT | sense |
| 1525-1544 | 8675 | CCUGCUGGGGACCUCAAGU | 8676 | CCUGCUGGGGACCUcAAGUdTsdT | antis |
| 1526-1545 | 8677 | CUUGAGGUCCCCAGCAGGC | 8678 | cuuGAGGuccccAGcAGGcdTsdT | sense |
| 1526-1545 | 8679 | GCCUGCUGGGGACCUCAAG | 8680 | GCCUGCUGGGGACCUcAAGdTsdT | antis |
| 1527-1546 | 8681 | UUGAGGUCCCCAGCAGGCC | 8682 | uuGAGGuccccAGcAGGccdTsdT | sense |
| 1527-1546 | 8683 | GGCCUGCUGGGGACCUCAA | 8684 | GGCCUGCUGGGGACCUcAAdTsdT | antis |
| 1530-1549 | 8685 | AGGUCCCCAGCAGGCCCUG | 8686 | AGGuccccAGcAGGcccuGdTsdT | sense |
| 1530-1549 | 8687 | CAGGGCCUGCUGGGGACCU | 8688 | cAGGGCCUGCUGGGGACCUdTsdT | antis |
| 1531-1550 | 8689 | GGUCCCCAGCAGGCCCUGC | 8690 | GGuccccAGcAGGcccuGcdTsdT | sense |
| 1531-1550 | 8691 | GCAGGGCCUGCUGGGGACC | 8692 | GcAGGGCCUGCUGGGGACCdTsdT | antis |
| 1532-1551 | 8693 | GUCCCCAGCAGGCCCUGCU | 8694 | GuccccAGcAGGcccuGcudTsdT | sense |
| 1532-1551 | 8695 | AGCAGGGCCUGCUGGGGAC | 8696 | AGcAGGGCCUGCUGGGGACdTsdT | antis |
| 1538-1557 | 8697 | AGCAGGCCCUGCUUCUCCC | 8698 | AGcAGGcccuGcuucucccdTsdT | sense |
| 1538-1557 | 8699 | GGGAGAAGCAGGGCCUGCU | 8700 | GGGAGAAGcAGGGCCUGCUdTsdT | antis |
| 1588-1607 | 8701 | CUUUAACUGAAGCUCAGAC | 8702 | cuuuAAcuGAAGcucAGAcdTsdT | sense |
| 1588-1607 | 8703 | GUCUGAGCUUCAGUUAAAG | 8704 | GUCUGAGCUUcAGUuAAAGdTsdT | antis |
| 1626-1645 | 8705 | UCUGAUGCCACAACUGCUA | 8706 | ucuGAuGccAcAAcuGcuAdTsdT | sense |
| 1626-1645 | 8707 | UAGCAGUUGUGGCAUCAGA | 8708 | uAGcAGUUGUGGcAUcAGAdTsdT | antis |
| 1627-1646 | 8709 | CUGAUGCCACAACUGCUAC | 8710 | cuGAuGccAcAAcuGcuAcdTsdT | sense |
| 1627-1646 | 8711 | GUAGCAGUUGUGGCAUCAG | 8712 | GuAGcAGUUGUGGcAUcAGdTsdT | antis |
| 1628-1647 | 8713 | UGAUGCCACAACUGCUACC | 8714 | uGAuGccAcAAcuGcuAccdTsdT | sense |
| 1628-1647 | 8715 | GGUAGCAGUUGUGGCAUCA | 8716 | GGuAGcAGUUGUGGcAUcAdTsdT | antis |
| 1629-1648 | 8717 | GAUGCCACAACUGCUACCC | 8718 | GAuGccAcAAcuGcuAcccdTsdT | sense |
| 1629-1648 | 8719 | GGGUAGCAGUUGUGGCAUC | 8720 | GGGuAGcAGUUGUGGcAUCdTsdT | antis |
| 1686-1705 | 8721 | CACGUCCAUCUGGGAAGGC | 8722 | cAcGuccAucuGGGAAGGcdTsdT | sense |
| 1686-1705 | 8723 | GCCUUCCCAGAUGGACGUG | 8724 | GCCUUCCcAGAUGGACGUGdTsdT | antis |
| 1687-1706 | 8725 | ACGUCCAUCUGGGAAGGCC | 8726 | AcGuccAucuGGGAAGGccdTsdT | sense |
| 1687-1706 | 8727 | GGCCUUCCCAGAUGGACGU | 8728 | GGCCUUCCcAGAUGGACGUdTsdT | antis |
| 1688-1707 | 8729 | CGUCCAUCUGGGAAGGCCC | 8730 | cGuccAucuGGGAAGGcccdTsdT | sense |
| 1688-1707 | 8731 | GGGCCUUCCCAGAUGGACG | 8732 | GGGCCUUCCcAGAUGGACGdTsdT | antis |
| 1689-1708 | 8733 | GUCCAUCUGGGAAGGCCCA | 8734 | GuccAucuGGGAAGGcccAdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1689-1708 | 8735 | UGGGCCUUCCCAGAUGGAC | 8736 | UGGGCCUUCCcAGAUGGACdTsdT | antis |
| 1694-1713 | 8737 | UCUGGGAAGGCCCAAGUGG | 8738 | ucuGGGAAGGcccAAGuGGdTsdT | sense |
| 1694-1713 | 8739 | CCACUUGGGCCUUCCCAGA | 8740 | CcACUUGGGCCUUCCcAGAdTsdT | antis |
| 1695-1714 | 8741 | CUGGGAAGGCCCAAGUGGC | 8742 | cuGGGAAGGcccAAGuGGcdTsdT | sense |
| 1695-1714 | 8743 | GCCACUUGGGCCUUCCCAG | 8744 | GCcACUUGGGCCUUCCcAGdTsdT | antis |
| 1709-1728 | 8745 | GUGGCGCUGGGAAGGGGGC | 8746 | GuGGcGcuGGGAAGGGGGcdTsdT | sense |
| 1709-1728 | 8747 | GCCCCCUUCCCAGCGCCAC | 8748 | GCCCCCUUCCcAGCGCcACdTsdT | antis |
| 1714-1733 | 8749 | GCUGGGAAGGGGGCCACAG | 8750 | GcuGGGAAGGGGGccAcAGdTsdT | sense |
| 1714-1733 | 8751 | CUGUGGCCCCCUUCCCAGC | 8752 | CUGUGGCCCCCUUCCcAGCdTsdT | antis |
| 1722-1741 | 8753 | GGGGGCCACAGCCCAUCAA | 8754 | GGGGGccAcAGcccAucAAdTsdT | sense |
| 1722-1741 | 8755 | UUGAUGGGCUGUGGCCCCC | 8756 | UUGAUGGGCUGUGGCCCCCdTsdT | antis |
| 1723-1742 | 8757 | GGGGCCACAGCCCAUCAAG | 8758 | GGGGccAcAGcccAucAAGdTsdT | sense |
| 1723-1742 | 8759 | CUUGAUGGGCUGUGGCCCC | 8760 | CUUGAUGGGCUGUGGCCCCdTsdT | antis |
| 1732-1751 | 8761 | GCCCAUCAAGCUCCUGCCC | 8762 | GcccAucAAGcuccuGcccdTsdT | sense |
| 1732-1751 | 8763 | GGGCAGGAGCUUGAUGGGC | 8764 | GGGcAGGAGCUUGAUGGGCdTsdT | antis |
| 1737-1756 | 8765 | UCAAGCUCCUGCCCUGGCU | 8766 | ucAAGcuccuGcccuGGcudTsdT | sense |
| 1737-1756 | 8767 | AGCCAGGGCAGGAGCUUGA | 8768 | AGCcAGGGcAGGAGCUUGAdTsdT | antis |
| 1743-1762 | 8769 | UCCUGCCCUGGCUGGGCCC | 8770 | uccuGcccuGGcuGGGcccdTsdT | sense |
| 1743-1762 | 8771 | GGGCCCAGCCAGGGCAGGA | 8772 | GGGCCcAGCcAGGGcAGGAdTsdT | antis |
| 1744-1763 | 8773 | CCUGCCCUGGCUGGGCCCC | 8774 | ccuGcccuGGcuGGGccccdTsdT | sense |
| 1744-1763 | 8775 | GGGGCCCAGCCAGGGCAGG | 8776 | GGGGCCcAGCcAGGGcAGGdTsdT | antis |
| 1746-1765 | 8777 | UGCCCUGGCUGGGCCCCUA | 8778 | uGcccuGGcuGGGccccuAdTsdT | sense |
| 1746-1765 | 8779 | UAGGGGCCCAGCCAGGGCA | 8780 | uAGGGGCCcAGCcAGGGcAdTsdT | antis |
| 1748-1767 | 8781 | CCCUGGCUGGGCCCCUAGA | 8782 | cccuGGcuGGGccccuAGAdTsdT | sense |
| 1748-1767 | 8783 | UCUAGGGGCCCAGCCAGGG | 8784 | UCuAGGGGCCcAGCcAGGGdTsdT | antis |
| 1769-1788 | 8785 | AGAGGGCAGAGGUAAAUGA | 8786 | AGAGGGcAGAGGuAAAuGAdTsdT | sense |
| 1769-1788 | 8787 | UCAUUUACCUCUGCCCUCU | 8788 | UcAUUuACCUCUGCCCUCUdTsdT | antis |
| 1770-1789 | 8789 | GAGGGCAGAGGUAAAUGAA | 8790 | GAGGGcAGAGGuAAAuGAAdTsdT | sense |
| 1770-1789 | 8791 | UUCAUUUACCUCUGCCCUC | 8792 | UUcAUUuACCUCUGCCCUCdTsdT | antis |
| 1798-1817 | 8793 | GCAUCUAGGCCUCCCUCAG | 8794 | GcAucuAGGccucccucAGdTsdT | sense |
| 1798-1817 | 8795 | CUGAGGGAGGCCUAGAUGC | 8796 | CUGAGGGAGGCCuAGAUGCdTsdT | antis |
| 1825-1844 | 8797 | CCUCUGUGGUGGGCUUUUU | 8798 | ccucuGuGGuGGGcuuuuudTsdT | sense |
| 1825-1844 | 8799 | AAAAAGCCCACCACAGAGG | 8800 | AAAAAGCCcAccAcAGAGGdTsdT | antis |
| 1831-1850 | 8801 | UGGUGGGCUUUUUAAAGAG | 8802 | uGGuGGGcuuuuuAAAGAGdTsdT | sense |
| 1831-1850 | 8803 | CUCUUUAAAAAGCCCACCA | 8804 | CUCUUuAAAAAGCCcACcAdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1833-1852 | 8805 | GUGGGCUUUUUAAAGAGGA | 8806 | GuGGGcuuuuuAAAGAGGAdTsdT | sense |
| 1833-1852 | 8807 | UCCUCUUUAAAAAGCCCAC | 8808 | UCCUCUUuAAAAAGCCcACdTsdT | antis |
| 1837-1856 | 8809 | GCUUUUUAAAGAGGAUUUU | 8810 | GcuuuuuAAAGAGGAuuuudTsdT | sense |
| 1837-1856 | 8811 | AAAAUCCUCUUUAAAAAGC | 8812 | AAAAUCCUCUUuAAAAAGCdTsdT | antis |
| 1838-1857 | 8813 | CUUUUUAAAGAGGAUUUUA | 8814 | cuuuuuAAAGAGGAuuuuAdTsdT | sense |
| 1838-1857 | 8815 | UAAAAUCCUCUUUAAAAAG | 8816 | uAAAAUCCUCUUuAAAAAGdTsdT | antis |
| 1869-1888 | 8817 | GGAGGGGAGAAAAGGAAGG | 8818 | GGAGGGGAGAAAAGGAAGGdTsdT | sense |
| 1869-1888 | 8819 | CCUUCCUUUUCUCCCCUCC | 8820 | CCUUCCUUUUCUCCCCUCCdTsdT | antis |
| 1870-1889 | 8821 | GAGGGGAGAAAAGGAAGGA | 8822 | GAGGGGAGAAAAGGAAGGAdTsdT | sense |
| 1870-1889 | 8823 | UCCUUCCUUUUCUCCCCUC | 8824 | UCCUUCCUUUUCUCCCCUCdTsdT | antis |
| 1888-1907 | 8825 | ACGGGGUUUGGGGGUGUGA | 8826 | AcGGGGuuuGGGGGuGuGAdTsdT | sense |
| 1888-1907 | 8827 | UCACACCCCAAACCCCGU | 8828 | UcAcACCCCcAAACCCCGUdTsdT | antis |
| 1923-1942 | 8829 | UGGUCCCCUCCCCUCCCCC | 8830 | uGGucccucccccucccccdTsdT | sense |
| 1923-1942 | 8831 | GGGGGAGGGGAGGGGACCA | 8832 | GGGGGAGGGGAGGGGACcAdTsdT | antis |
| 1924-1943 | 8833 | GGUCCCCUCCCCUCCCCCA | 8834 | GGucccucccccucccccAdTsdT | sense |
| 1924-1943 | 8835 | UGGGGGAGGGGAGGGGACC | 8836 | UGGGGGAGGGGAGGGGACCdTsdT | antis |
| 1931-1950 | 8837 | UCCCCUCCCCCAGGCUACC | 8838 | uccccucccccAGGcuAccdTsdT | sense |
| 1931-1950 | 8839 | GGUAGCCUGGGGGAGGGGA | 8840 | GGuAGCCUGGGGGAGGGGAdTsdT | antis |
| 1962-1981 | 8841 | CCCCCCUCUCCCAGGUCCC | 8842 | ccccccucucccAGGucccdTsdT | sense |
| 1962-1981 | 8843 | GGGACCUGGGAGAGGGGGG | 8844 | GGGACCUGGGAGAGGGGGGdTsdT | antis |
| 1963-1982 | 8845 | CCCCCUCUCCCAGGUCCCU | 8846 | cccccucucccAGGucccudTsdT | sense |
| 1963-1982 | 8847 | AGGGACCUGGGAGAGGGGG | 8848 | AGGGACCUGGGAGAGGGGGdTsdT | antis |
| 2132-2151 | 8849 | CCAAGGCUUCCUCCCUCUC | 8850 | ccAAGGcuuccucccucucdTsdT | sense |
| 2132-2151 | 8851 | GAGAGGGAGGAAGCCUUGG | 8852 | GAGAGGGAGGAAGCCUUGGdTsdT | antis |
| 2139-2158 | 8853 | UUCCUCCCUCUCCCCAUCC | 8854 | uuccucccucuccccAuccdTsdT | sense |
| 2139-2158 | 8855 | GGAUGGGGAGAGGGAGGAA | 8856 | GGAUGGGGAGAGGGAGGAAdTsdT | antis |
| 63-82 | 8857 | UGGGCCGGAGCCGGAGCCC | 8858 | uGGGccGGAGccGGAGcccdTsdT | sense |
| 63-82 | 8859 | GGGCUCCGGCUCCGGCCCA | 8860 | GGGCUCCGGCUCCGGCCcAdTsdT | antis |
| 65-84 | 8861 | GGCCGGAGCCGGAGCCCGA | 8862 | GGccGGAGccGGAGcccGAdTsdT | sense |
| 65-84 | 8863 | UCGGGCUCCGGCUCCGGCC | 8864 | UCGGGCUCCGGCUCCGGCCdTsdT | antis |
| 66-85 | 8865 | GCCGGAGCCGGAGCCCGAA | 8866 | GccGGAGccGGAGcccGAAdTsdT | sense |
| 66-85 | 8867 | UUCGGGCUCCGGCUCCGGC | 8868 | UUCGGGCUCCGGCUCCGGCdTsdT | antis |
| 115-134 | 8869 | GGGAGGCGGCGGCAGAGGC | 8870 | GGGAGGcGGcGGcAGAGGcdTsdT | sense |
| 115-134 | 8871 | GCCUCUGCCGCCGCCUCCC | 8872 | GCCUCUGCCGCCGCCUCCCdTsdT | antis |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 118-137 | 8873 | AGGCGGCGGCAGAGGCAGC | 8874 | AGGcGGcGGcAGAGGcAGcdTsdT | sense |
| 118-137 | 8875 | GCUGCCUCUGCCGCCGCCU | 8876 | GCUGCCUCUGCCGCCGCCUdTsdT | antis |
| 119-138 | 8877 | GGCGGCGGCAGAGGCAGCG | 8878 | GGcGGcGGcAGAGGcAGcGdTsdT | sense |
| 119-138 | 8879 | CGCUGCCUCUGCCGCCGCC | 8880 | CGCUGCCUCUGCCGCCGCCdTsdT | antis |
| 128-147 | 8881 | AGAGGCAGCGGCGGGGGCA | 8882 | AGAGGcAGcGGcGGGGGcAdTsdT | sense |
| 128-147 | 8883 | UGCCCCCGCCGCUGCCUCU | 8884 | UGCCCCCGCCGCUGCCUCUdTsdT | antis |
| 129-148 | 8885 | GAGGCAGCGGCGGGGGCAG | 8886 | GAGGcAGcGGcGGGGGcAGdTsdT | sense |
| 129-148 | 8887 | CUGCCCCCGCCGCUGCCUC | 8888 | CUGCCCCCGCCGCUGCCUCdTsdT | antis |
| 265-284 | 8889 | CAGGAGGCGGAGGCGGAGG | 8890 | cAGGAGGcGGAGGcGGAGGdTsdT | sense |
| 265-284 | 8891 | CCUCCGCCUCCGCCUCCUG | 8892 | CCUCCGCCUCCGCCUCCUGdTsdT | antis |
| 266-285 | 8893 | AGGAGGCGGAGGCGGAGGU | 8894 | AGGAGGcGGAGGcGGAGGudTsdT | sense |
| 266-285 | 8895 | ACCUCCGCCUCCGCCUCCU | 8896 | ACCUCCGCCUCCGCCUCCUdTsdT | antis |
| 269-288 | 8897 | AGGCGGAGGCGGAGGUGGU | 8898 | AGGcGGAGGcGGAGGuGGudTsdT | sense |
| 269-288 | 8899 | ACCACCUCCGCCUCCGCCU | 8900 | ACcACCUCCGCCUCCGCCUdTsdT | antis |
| 275-294 | 8901 | AGGCGGAGGUGGUGGCGGC | 8902 | AGGcGGAGGuGGuGGcGGcdTsdT | sense |
| 275-294 | 8903 | GCCGCCACCACCUCCGCCU | 8904 | GCCGCcACcACCUCCGCCUdTsdT | antis |
| 278-297 | 8905 | CGGAGGUGGUGGCGGCGGC | 8906 | cGGAGGuGGuGGcGGcGGcdTsdT | sense |
| 278-297 | 8907 | GCCGCCGCCACCACCUCCG | 8908 | GCCGCCGCcAcCACCUCCGdTsdT | antis |
| 279-298 | 8909 | GGAGGUGGUGGCGGCGGCC | 8910 | GGAGGuGGuGGcGGcGGccdTsdT | sense |
| 279-298 | 8911 | GGCCGCCGCCACCACCUCC | 8912 | GGCCGCCGCcACcACCUCCdTsdT | antis |
| 314-333 | 8913 | UGGCCCAGGAGGCACUGGC | 8914 | uGGcccAGGAGGcAcuGGcdTsdT | sense |
| 314-333 | 8915 | GCCAGUGCCUCCUGGGCCA | 8916 | GCcAGUGCCUCCUGGGCcAdTsdT | antis |
| 399-418 | 8917 | AGCGGCAGCGGCGGAGGAG | 8918 | AGcGGcAGcGGcGGAGGAGdTsdT | sense |
| 399-418 | 8919 | CUCCUCCGCCGCUGCCGCU | 8920 | CUCCUCCGCCGCUGCCGCUdTsdT | antis |
| 411-430 | 8921 | GGAGGAGGCAGCGGUGGCC | 8922 | GGAGGAGGcAGcGGuGGccdTsdT | sense |
| 411-430 | 8923 | GGCCACCGCUGCCUCCUCC | 8924 | GGCcACCGCUGCCUCCUCCdTsdT | antis |
| 412-431 | 8925 | GAGGAGGCAGCGGUGGCCC | 8926 | GAGGAGGcAGcGGuGGcccdTsdT | sense |
| 412-431 | 8927 | GGGCCACCGCUGCCUCCUC | 8928 | GGGCcACCGCUGCCUCCUCdTsdT | antis |
| 413-432 | 8929 | AGGAGGCAGCGGUGGCCCC | 8930 | AGGAGGcAGcGGuGGccccdTsdT | sense |
| 413-432 | 8931 | GGGGCCACCGCUGCCUCCU | 8932 | GGGGCcACCGCUGCCUCCUdTsdT | antis |
| 414-433 | 8933 | GGAGGCAGCGGUGGCCCCG | 8934 | GGAGGcAGcGGuGGccccGdTsdT | sense |
| 414-433 | 8935 | CGGGGCCACCGCUGCCUCC | 8936 | CGGGGCcACCGCUGCCUCCdTsdT | antis |
| 636-655 | 8937 | AAGGUUCUUCAGGACAAAA | 8938 | AAGGuucuucAGGAcAAAAdTsdT | sense |
| 636-655 | 8939 | UUUUGUCCUGAAGAACCUU | 8940 | UUUUGUCCUGAAGAACCUUdTsdT | antis |
| 731-750 | 8941 | CUCCAGUGGGGAGAAGAAG | 8942 | cuccAGuGGGGAGAAGAAGdTsdT | sense |

TABLE 1-continued

Sequences of duplexes targeting Mouse GSK3-alpha
Sequences of possible duplexes targeting mouse GSK3-alpha.
Target sequence location identifies target sequence in mouse
GSK3-alpha mRNA NM_001031667.1. Unmodified sense
strand is identical to target sequence. Unmodified a antisense
strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 731-750 | 8943 | CUUCUUCUCCCCACUGGAG | 8944 | CUUCUUCUCCCcACUGGAGdTsdT | antis |
| 733-752 | 8945 | CCAGUGGGGAGAAGAAGGA | 8946 | ccAGuGGGGAGAAGAAGGAdTsdT | sense |
| 733-752 | 8947 | UCCUUCUUCUCCCCACUGG | 8948 | UCCUUCUUCUCCCcACUGGdTsdT | antis |
| 963-982 | 8949 | GUCCUCAAGCUCUGCGAUU | 8950 | GuccucAAGcucuGcGAuudTsdT | sense |
| 963-982 | 8951 | AAUCGCAGAGCUUGAGGAC | 8952 | AAUCGcAGAGCUUGAGGACdTsdT | antis |
| 1535-1554 | 8953 | CCCAGCAGGCCCUGCUUCU | 8954 | cccAGcAGGcccuGcuucudTsdT | sense |
| 1535-1554 | 8955 | AGAAGCAGGGCCUGCUGGG | 8956 | AGAAGcAGGGCCUGCUGGGdTsdT | antis |
| 1536-1555 | 8957 | CCAGCAGGCCCUGCUUCUC | 8958 | ccAGcAGGcccuGcuucucdTsdT | sense |
| 1536-1555 | 8959 | GAGAAGCAGGGCCUGCUGG | 8960 | GAGAAGcAGGGCCUGCUGGdTsdT | antis |
| 1537-1556 | 8961 | CAGCAGGCCCUGCUUCUCC | 8962 | cAGcAGGcccuGcuucuccdTsdT | sense |
| 1537-1556 | 8963 | GGAGAAGCAGGGCCUGCUG | 8964 | GGAGAAGcAGGGCCUGCUGdTsdT | antis |
| 1887-1906 | 8965 | GACGGGGUUUGGGGGUGUG | 8966 | GAcGGGGuuuGGGGGuGuGdTsdT | sense |
| 1887-1906 | 8967 | CACACCCCAAACCCCGUC | 8968 | cAcACCCCcAAACCCCGUCdTsdT | antis |
| 1925-1944 | 8969 | GUCCCCUCCCCUCCCCCAG | 8970 | GucccCucccCucccccAGdTsdT | sense |
| 1925-1944 | 8971 | CUGGGGGAGGGGAGGGGAC | 8972 | CUGGGGGAGGGGAGGGGACdTsdT | antis |
| 1926-1945 | 8973 | UCCCCUCCCCUCCCCCAGG | 8974 | ucccCucccCucccccAGGdTsdT | sense |
| 1926-1945 | 8975 | CCUGGGGGAGGGGAGGGGA | 8976 | CCUGGGGGAGGGGAGGGGAdTsdT | antis |
| 2055-2074 | 8977 | AUUUUUUCUUAAAGAAAAC | 8978 | AuuuuuucuuAAAGAAAAcdTsdT | sense |
| 2055-2074 | 8979 | GUUUUCUUUAAGAAAAAAU | 8980 | GUUUUCUUuAAGAAAAAAUdTsdT | antis |
| 2143-2162 | 8981 | UCCCUCUCCCCAUCCUGGA | 8982 | ucccucuccccAuccuGGAdTsdT | sense |
| 2143-2162 | 8983 | UCCAGGAUGGGGAGAGGGA | 8984 | UCcAGGAUGGGGAGAGGGAdTsdT | antis |

TABLE 2

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1842-1861 | 8985 | ACUGUAACAUAGUCCGACU | 10985 | AcuGuAAcAuAGuccGAcudTsdT | sense |
| 1842-1861 | 8986 | AGUCGGACUAUGUUACAGU | 10986 | AGUCGGACuAUGUuAcAGUdTsdT | antis |
| 1843-1862 | 8987 | CUGUAACAUAGUCCGACUG | 10987 | cuGuAAcAuAGuccGAcuGdTsdT | sense |
| 1843-1862 | 8988 | CAGUCGGACUAUGUUACAG | 10988 | cAGUCGGACuAUGUuAcAGdTsdT | antis |
| 1952-1971 | 8989 | GCCAGACACUAUAGUCGAG | 10989 | GccAGAcAcuAuAGucGAGdTsdT | sense |
| 1952-1971 | 8990 | CUCGACUAUAGUGUCUGGC | 10990 | CUCGACuAuAGUGUCUGGCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1847-1866 | 8991 | AACAUAGUCCGACUGCGGU | 10991 | AAcAuAGuccGAcuGcGGudTsdT | sense |
| 1847-1866 | 8992 | ACCGCAGUCGGACUAUGUU | 10992 | ACCGcAGUCGGACuAUGUUdTsdT | antis |
| 1838-1857 | 8993 | GACCACUGUAACAUAGUCC | 10993 | GAccAcuGuAAcAuAGuccdTsdT | sense |
| 1838-1857 | 8994 | GGACUAUGUUACAGUGGUC | 10994 | GGACuAUGUuAcAGUGGUCdTsdT | antis |
| 1846-1865 | 8995 | UAACAUAGUCCGACUGCGG | 10995 | uAAcAuAGuccGAcuGcGGdTsdT | sense |
| 1846-1865 | 8996 | CCGCAGUCGGACUAUGUUA | 10996 | CCGcAGUCGGACuAUGUuAdTsdT | antis |
| 1849-1868 | 8997 | CAUAGUCCGACUGCGGUAU | 10997 | cAuAGuccGAcuGcGGuAudTsdT | sense |
| 1849-1868 | 8998 | AUACCGCAGUCGGACUAUG | 10998 | AuACCGcAGUCGGACuAUGdTsdT | antis |
| 1955-1974 | 8999 | AGACACUAUAGUCGAGCCA | 10999 | AGAcAcuAuAGucGAGccAdTsdT | sense |
| 1955-1974 | 9000 | UGGCUCGACUAUAGUGUCU | 11000 | UGGCUCGACuAuAGUGUCUdTsdT | antis |
| 1957-1976 | 9001 | ACACUAUAGUCGAGCCAAG | 11001 | AcAcuAuAGucGAGccAAGdTsdT | sense |
| 1957-1976 | 9002 | CUUGGCUCGACUAUAGUGU | 11002 | CUUGGCUCGACuAuAGUGUdTsdT | antis |
| 2169-2188 | 9003 | CAUAUAUCUGUUCUCGGUA | 11003 | cAuAuAucuGuucucGGuAdTsdT | sense |
| 2169-2188 | 9004 | UACCGAGAACAGAUAUAUG | 11004 | uACCGAGAAcAGAuAuAUGdTsdT | antis |
| 1788-1807 | 9005 | UACAGGACAAGCGAUUUAA | 11005 | uAcAGGAcAAGcGAuuuAAdTsdT | sense |
| 1788-1807 | 9006 | UUAAAUCGCUUGUCCUGUA | 11006 | UuAAAUCGCUUGUCCUGuAdTsdT | antis |
| 1862-1881 | 9007 | CGGUAUUUCUUCUACUCGA | 11007 | cGGuAuuucuucuAcucGAdTsdT | sense |
| 1862-1881 | 9008 | UCGAGUAGAAGAAAUACCG | 11008 | UCGAGuAGAAGAAAuACCGdTsdT | antis |
| 2021-2040 | 9009 | UUCAGAAGUCUAGCCUAUA | 11009 | uucAGAAGucuAGccuAuAdTsdT | sense |
| 2021-2040 | 9010 | UAUAGGCUAGACUUCUGAA | 11010 | uAuAGGCuAGACUUCUGAAdTsdT | antis |
| 1863-1882 | 9011 | GGUAUUUCUUCUACUCGAG | 11011 | GGuAuuucuucuAcucGAGdTsdT | sense |
| 1863-1882 | 9012 | CUCGAGUAGAAGAAAUACC | 11012 | CUCGAGuAGAAGAAAuACCdTsdT | antis |
| 2496-2515 | 9013 | CACCUACCGCCCGGCUAAC | 11013 | cAccuAccGcccGGcuAAcdTsdT | sense |
| 2496-2515 | 9014 | GUUAGCCGGGCGGUAGGUG | 11014 | GUuAGCCGGGCGGuAGGUGdTsdT | antis |
| 1796-1815 | 9015 | AAGCGAUUUAAGAACCGAG | 11015 | AAGcGAuuuAAGAAccGAGdTsdT | sense |
| 1796-1815 | 9016 | CUCGGUUCUUAAAUCGCUU | 11016 | CUCGGUUCUuAAAUCGCUUdTsdT | antis |
| 1844-1863 | 9017 | UGUAACAUAGUCCGACUGC | 11017 | uGuAAcAuAGuccGAcuGcdTsdT | sense |
| 1844-1863 | 9018 | GCAGUCGGACUAUGUUACA | 11018 | GcAGUCGGACuAUGUuAcAdTsdT | antis |
| 2221-2240 | 9019 | UGAUUACACGUCCAGUAUA | 11019 | uGAuuAcAcGuccAGuAuAdTsdT | sense |
| 2221-2240 | 9020 | UAUACUGGACGUGUAAUCA | 11020 | uAuACUGGACGUGuAAUcAdTsdT | antis |
| 2228-2247 | 9021 | ACGUCCAGUAUAGAUGUAU | 11021 | AcGuccAGuAuAGAuGuAudTsdT | sense |
| 2228-2247 | 9022 | AUACAUCUAUACUGGACGU | 11022 | AuAcAUCuAuACUGGACGUdTsdT | antis |
| 1697-1716 | 9023 | GACACGAAAGUGAUUGGAA | 11023 | GAcAcGAAAGuGAuuGGAAdTsdT | sense |
| 1697-1716 | 9024 | UUCCAAUCACUUUCGUGUC | 11024 | UUCcAAUcACUUUCGUGUCdTsdT | antis |
| 1845-1864 | 9025 | GUAACAUAGUCCGACUGCG | 11025 | GuAAcAuAGuccGAcuGcGdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1845-1864 | 9026 | CGCAGUCGGACUAUGUUAC | 11026 | CGcAGUCGGACuAUGUuACdTsdT | antis |
| 1851-1870 | 9027 | UAGUCCGACUGCGGUAUUU | 11027 | uAGuccGAcuGcGGuAuuudTsdT | sense |
| 1851-1870 | 9028 | AAAUACCGCAGUCGGACUA | 11028 | AAAuACCGcAGUCGGACuAdTsdT | antis |
| 1871-1890 | 9029 | UUCUACUCGAGUGGUGAGA | 11029 | uucuAcucGAGuGGuGAGAdTsdT | sense |
| 1871-1890 | 9030 | UCUCACCACUCGAGUAGAA | 11030 | UCUcACcACUCGAGuAGAAdTsdT | antis |
| 2022-2041 | 9031 | UCAGAAGUCUAGCCUAUAU | 11031 | ucAGAAGucuAGccuAuAudTsdT | sense |
| 2022-2041 | 9032 | AUAUAGGCUAGACUUCUGA | 11032 | AuAuAGGCuAGACUUCUGAdTsdT | antis |
| 2024-2043 | 9033 | AGAAGUCUAGCCUAUAUCC | 11033 | AGAAGucuAGccuAuAuccdTsdT | sense |
| 2024-2043 | 9034 | GGAUAUAGGCUAGACUUCU | 11034 | GGAuAuAGGCuAGACUUCUdTsdT | antis |
| 2220-2239 | 9035 | CUGAUUACACGUCCAGUAU | 11035 | cuGAuuAcAcGuccAGuAudTsdT | sense |
| 2220-2239 | 9036 | AUACUGGACGUGUAAUCAG | 11036 | AuACUGGACGUGuAAUcAGdTsdT | antis |
| 1789-1808 | 9037 | ACAGGACAAGCGAUUUAAG | 11037 | AcAGGAcAAGcGAuuuAAGdTsdT | sense |
| 1789-1808 | 9038 | CUUAAAUCGCUUGUCCUGU | 11038 | CUuAAAUCGCUUGUCCUGUdTsdT | antis |
| 1922-1941 | 9039 | GACUAUGUUCCGGAGACAG | 11039 | GAcuAuGuuccGGAGAcAGdTsdT | sense |
| 1922-1941 | 9040 | CUGUCUCCGGAACAUAGUC | 11040 | CUGUCUCCGGAAcAuAGUCdTsdT | antis |
| 2020-2039 | 9041 | GUUCAGAAGUCUAGCCUAU | 11041 | GuucAGAAGucuAGccuAudTsdT | sense |
| 2020-2039 | 9042 | AUAGGCUAGACUUCUGAAC | 11042 | AuAGGCuAGACUUCUGAACdTsdT | antis |
| 2492-2511 | 9043 | UACACACCUACCGCCCGGC | 11043 | uAcAcAccuAccGcccGGcdTsdT | sense |
| 2492-2511 | 9044 | GCCGGGCGGUAGGUGUGUA | 11044 | GCCGGGCGGuAGGUGUGuAdTsdT | antis |
| 1678-1697 | 9045 | ACAGGAAGUCAGUUAUACA | 11045 | AcAGGAAGucAGuuAuAcAdTsdT | sense |
| 1678-1697 | 9046 | UGUAUAACUGACUUCCUGU | 11046 | UGuAuAACUGACUUCCUGUdTsdT | antis |
| 1840-1859 | 9047 | CCACUGUAACAUAGUCCGA | 11047 | ccAcuGuAAcAuAGuccGAdTsdT | sense |
| 1840-1859 | 9048 | UCGGACUAUGUUACAGUGG | 11048 | UCGGACuAUGUuAcAGUGGdTsdT | antis |
| 2487-2506 | 9049 | UGGAGUACACACCUACCGC | 11049 | uGGAGuAcAcAccuAccGcdTsdT | sense |
| 2487-2506 | 9050 | GCGGUAGGUGUGUACUCCA | 11050 | GCGGuAGGUGUGuACUCcAdTsdT | antis |
| 1924-1943 | 9051 | CUAUGUUCCGGAGACAGUG | 11051 | cuAuGuuccGGAGAcAGuGdTsdT | sense |
| 1924-1943 | 9052 | CACUGUCUCCGGAACAUAG | 11052 | cACUGUCUCCGGAAcAuAGdTsdT | antis |
| 2176-2195 | 9053 | CUGUUCUCGGUACUACAGG | 11053 | cuGuucucGGuAcuAcAGGdTsdT | sense |
| 2176-2195 | 9054 | CCUGUAGUACCGAGAACAG | 11054 | CCUGuAGuACCGAGAAcAGdTsdT | antis |
| 2177-2196 | 9055 | UGUUCUCGGUACUACAGGG | 11055 | uGuucucGGuAcuAcAGGGdTsdT | sense |
| 2177-2196 | 9056 | CCCUGUAGUACCGAGAACA | 11056 | CCCUGuAGuACCGAGAAcAdTsdT | antis |
| 2502-2521 | 9057 | CCGCCCGGCUAACACCACU | 11057 | ccGcccGGcuAAcAccAcudTsdT | sense |
| 2502-2521 | 9058 | AGUGGUGUUAGCCGGGCGG | 11058 | AGUGGUGUuAGCCGGGCGGdTsdT | antis |
| 2499-2518 | 9059 | CUACCGCCCGGCUAACACC | 11059 | cuAccGcccGGcuAAcAccdTsdT | sense |
| 2499-2518 | 9060 | GGUGUUAGCCGGGCGGUAG | 11060 | GGUGUuAGCCGGGCGGuAGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2223-2242 | 9061 | AUUACACGUCCAGUAUAGA | 11061 | AuuAcAcGuccAGuAuAGAdTsdT | sense |
| 2223-2242 | 9062 | UCUAUACUGGACGUGUAAU | 11062 | UCuAuACUGGACGUGUAAUdTsdT | antis |
| 1873-1892 | 9063 | CUACUCGAGUGGUGAGAAG | 11063 | cuAcucGAGuGGuGAGAAGdTsdT | sense |
| 1873-1892 | 9064 | CUUCUCACCACUCGAGUAG | 11064 | CUUCUcACcACUCGAGuAGdTsdT | antis |
| 1918-1937 | 9065 | GCUGGACUAUGUUCCGGAG | 11065 | GcuGGAcuAuGuuccGGAGdTsdT | sense |
| 1918-1937 | 9066 | CUCCGGAACAUAGUCCAGC | 11066 | CUCCGGAAcAuAGUCcAGCdTsdT | antis |
| 1919-1938 | 9067 | CUGGACUAUGUUCCGGAGA | 11067 | cuGGAcuAuGuuccGGAGAdTsdT | sense |
| 1919-1938 | 9068 | UCUCCGGAACAUAGUCCAG | 11068 | UCUCCGGAAcAuAGUCcAGdTsdT | antis |
| 1950-1969 | 9069 | UCGCCAGACACUAUAGUCG | 11069 | ucGccAGAcAcuAuAGucGdTsdT | sense |
| 1950-1969 | 9070 | CGACUAUAGUGUCUGGCGA | 11070 | CGACuAuAGUGUCUGGCGAdTsdT | antis |
| 1958-1977 | 9071 | CACUAUAGUCGAGCCAAGC | 11071 | cAcuAuAGucGAGccAAGCdTsdT | sense |
| 1958-1977 | 9072 | GCUUGGCUCGACUAUAGUG | 11072 | GCUUGGCUCGACuAuAGUGdTsdT | antis |
| 2222-2241 | 9073 | GAUUACACGUCCAGUAUAG | 11073 | GAuuAcAcGuccAGuAuAGdTsdT | sense |
| 2222-2241 | 9074 | CUAUACUGGACGUGUAAUC | 11074 | CuAuACUGGACGUGuAAUCdTsdT | antis |
| 2224-2243 | 9075 | UUACACGUCCAGUAUAGAU | 11075 | uuAcAcGuccAGuAuAGAudTsdT | sense |
| 2224-2243 | 9076 | AUCUAUACUGGACGUGUAA | 11076 | AUCuAuACUGGACGUGuAAdTsdT | antis |
| 2440-2459 | 9077 | CCGGCCCCGAACUCCACCA | 11077 | ccGGccccGAAcuccAccAdTsdT | sense |
| 2440-2459 | 9078 | UGGUGGAGUUCGGGCCGG | 11078 | UGGUGGAGUUCGGGCCGGdTsdT | antis |
| 2493-2512 | 9079 | ACACACCUACCGCCCGGCU | 11079 | AcAcAccuAccGcccGGcudTsdT | sense |
| 2493-2512 | 9080 | AGCCGGGCGGUAGGUGUGU | 11080 | AGCCGGGCGGuAGGUGUGUdTsdT | antis |
| 2494-2513 | 9081 | CACACCUACCGCCCGGCUA | 11081 | cAcAccuAccGcccGGcuAdTsdT | sense |
| 2494-2513 | 9082 | UAGCCGGGCGGUAGGUGUG | 11082 | uAGCCGGGCGGuAGGUGUGdTsdT | antis |
| 2497-2516 | 9083 | ACCUACCGCCCGGCUAACA | 11083 | AccuAccGcccGGcuAAcAdTsdT | sense |
| 2497-2516 | 9084 | UGUUAGCCGGGCGGUAGGU | 11084 | UGUuAGCCGGGCGGuAGGUdTsdT | antis |
| 2498-2517 | 9085 | CCUACCGCCCGGCUAACAC | 11085 | ccuAccGcccGGcuAAcAcdTsdT | sense |
| 2498-2517 | 9086 | GUGUUAGCCGGGCGGUAGG | 11086 | GUGUuAGCCGGGCGGuAGGdTsdT | antis |
| 1525-1544 | 9087 | CAUGUCGGGGCGACCGAGA | 11087 | cAuGucGGGGcGAccGAGAdTsdT | sense |
| 1525-1544 | 9088 | UCUCGGUCGCCCCGACAUG | 11088 | UCUCGGUCGCCCCGAcAUGdTsdT | antis |
| 1528-1547 | 9089 | GUCGGGGCGACCGAGAACC | 11089 | GucGGGGcGAccGAGAAccdTsdT | sense |
| 1528-1547 | 9090 | GGUUCUCGGUCGCCCCGAC | 11090 | GGUUCUCGGUCGCCCCGACdTsdT | antis |
| 1533-1552 | 9091 | GGCGACCGAGAACCACCUC | 11091 | GGcGAccGAGAAccAccucdTsdT | sense |
| 1533-1552 | 9092 | GAGGUGGUUCUCGGUCGCC | 11092 | GAGGUGGUUCUCGGUCGCCdTsdT | antis |
| 1793-1812 | 9093 | GACAAGCGAUUUAAGAACC | 11093 | GAcAAGcGAuuuAAGAAccdTsdT | sense |
| 1793-1812 | 9094 | GGUUCUUAAAUCGCUUGUC | 11094 | GGUUCUuAAAUCGCUUGUCdTsdT | antis |
| 1797-1816 | 9095 | AGCGAUUUAAGAACCGAGA | 11095 | AGcGAuuuAAGAAccGAGAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1797-1816 | 9096 | UCUCGGUUCUUAAAUCGCU | 11096 | UCUCGGUUCUuAAAUCGCUdTsdT | antis |
| 1798-1817 | 9097 | GCGAUUUAAGAACCGAGAG | 11097 | GcGAuuuAAGAAccGAGAGdTsdT | sense |
| 1798-1817 | 9098 | CUCUCGGUUCUUAAAUCGC | 11098 | CUCUCGGUUCUuAAAUCGCdTsdT | antis |
| 1799-1818 | 9099 | CGAUUUAAGAACCGAGAGC | 11099 | cGAuuuAAGAAccGAGAGCdTsdT | sense |
| 1799-1818 | 9100 | GCUCUCGGUUCUUAAAUCG | 11100 | GCUCUCGGUUCUuAAAUCGdTsdT | antis |
| 1832-1851 | 9101 | AAGCUAGACCACUGUAACA | 11101 | AAGcuAGAccAcuGuAAcAdTsdT | sense |
| 1832-1851 | 9102 | UGUUACAGUGGUCUAGCUU | 11102 | UGUuAcAGUGGUCuAGCUUdTsdT | antis |
| 1836-1855 | 9103 | UAGACCACUGUAACAUAGU | 11103 | uAGAccAcuGuAAcAuAGudTsdT | sense |
| 1836-1855 | 9104 | ACUAUGUUACAGUGGUCUA | 11104 | ACuAUGUuAcAGUGGUCuAdTsdT | antis |
| 1850-1869 | 9105 | AUAGUCCGACUGCGGUAUU | 11105 | AuAGuccGAcuGcGGuAuudTsdT | sense |
| 1850-1869 | 9106 | AAUACCGCAGUCGGACUAU | 11106 | AAuACCGcAGUCGGACuAUdTsdT | antis |
| 1852-1871 | 9107 | AGUCCGACUGCGGUAUUUC | 11107 | AGuccGAcuGcGGuAuuucdTsdT | sense |
| 1852-1871 | 9108 | GAAAUACCGCAGUCGGACU | 11108 | GAAAuACCGcAGUCGGACUdTsdT | antis |
| 1853-1872 | 9109 | GUCCGACUGCGGUAUUUCU | 11109 | GuccGAcuGcGGuAuuucudTsdT | sense |
| 1853-1872 | 9110 | AGAAAUACCGCAGUCGGAC | 11110 | AGAAAuACCGcAGUCGGACdTsdT | antis |
| 1855-1874 | 9111 | CCGACUGCGGUAUUUCUUC | 11111 | ccGAcuGcGGuAuuucuucdTsdT | sense |
| 1855-1874 | 9112 | GAAGAAAUACCGCAGUCGG | 11112 | GAAGAAAuACCGcAGUCGGdTsdT | antis |
| 1870-1889 | 9113 | CUUCUACUCGAGUGGUGAG | 11113 | cuucuAcucGAGuGGuGAGdTsdT | sense |
| 1870-1889 | 9114 | CUCACCACUCGAGUAGAAG | 11114 | CUcACcACUCGAGuAGAAGdTsdT | antis |
| 1895-1914 | 9115 | GAUGAGGUCUACCUUAACC | 11115 | GAuGAGGucuAccuuAAccdTsdT | sense |
| 1895-1914 | 9116 | GGUUAAGGUAGACCUCAUC | 11116 | GGUuAAGGuAGACCUcAUCdTsdT | antis |
| 1916-1935 | 9117 | GUGCUGGACUAUGUUCCGG | 11117 | GuGcuGGAcuAuGuuccGGdTsdT | sense |
| 1916-1935 | 9118 | CCGGAACAUAGUCCAGCAC | 11118 | CCGGAAcAuAGUCcAGcACdTsdT | antis |
| 1927-1946 | 9119 | UGUUCCGGAGACAGUGUAC | 11119 | uGuuccGGAGAcAGuGuAcdTsdT | sense |
| 1927-1946 | 9120 | GUACACUGUCUCCGGAACA | 11120 | GuAcACUGUCUCCGGAAcAdTsdT | antis |
| 1953-1972 | 9121 | CCAGACACUAUAGUCGAGC | 11121 | ccAGAcAcuAuAGucGAGcdTsdT | sense |
| 1953-1972 | 9122 | GCUCGACUAUAGUGUCUGG | 11122 | GCUCGACuAuAGUGUCUGGdTsdT | antis |
| 1959-1978 | 9123 | ACUAUAGUCGAGCCAAGCA | 11123 | AcuAuAGucGAGccAAGcAdTsdT | sense |
| 1959-1978 | 9124 | UGCUUGGCUCGACUAUAGU | 11124 | UGCUUGGCUCGACuAuAGUdTsdT | antis |
| 1960-1979 | 9125 | CUAUAGUCGAGCCAAGCAG | 11125 | cuAuAGucGAGccAAGcAGdTsdT | sense |
| 1960-1979 | 9126 | CUGCUUGGCUCGACUAUAG | 11126 | CUGCUUGGCUCGACuAuAGdTsdT | antis |
| 2023-2042 | 9127 | CAGAAGUCUAGCCUAUAUC | 11127 | cAGAAGucuAGccuAuAucdTsdT | sense |
| 2023-2042 | 9128 | GAUAUAGGCUAGACUUCUG | 11128 | GAuAuAGGCuAGACUUCUGdTsdT | antis |
| 2089-2108 | 9129 | GUUGGAUCCUGAUACAGCU | 11129 | GuuGGAuccuGAuAcAGcudTsdT | sense |
| 2089-2108 | 9130 | AGCUGUAUCAGGAUCCAAC | 11130 | AGCUGuAUcAGGAUCcAACdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2179-2198 | 9131 | UUCUCGGUACUACAGGGCA | 11131 | uucucGGuAcuAcAGGGcAdTsdT | sense |
| 2179-2198 | 9132 | UGCCCUGUAGUACCGAGAA | 11132 | UGCCCUGuAGuACCGAGAAdTsdT | antis |
| 2188-2207 | 9133 | CUACAGGGCACCAGAGUUG | 11133 | cuAcAGGGcAccAGAGuuGdTsdT | sense |
| 2188-2207 | 9134 | CAACUCUGGUGCCCUGUAG | 11134 | cAACUCUGGUGCCCUGuAGdTsdT | antis |
| 2218-2237 | 9135 | CACUGAUUACACGUCCAGU | 11135 | cAcuGAuuAcAcGuccAGudTsdT | sense |
| 2218-2237 | 9136 | ACUGGACGUGUAAUCAGUG | 11136 | ACUGGACGUGuAAUcAGUGdTsdT | antis |
| 2219-2238 | 9137 | ACUGAUUACACGUCCAGUA | 11137 | AcuGAuuAcAcGuccAGuAdTsdT | sense |
| 2219-2238 | 9138 | UACUGGACGUGUAAUCAGU | 11138 | uACUGGACGUGuAAUcAGUdTsdT | antis |
| 2226-2245 | 9139 | ACACGUCCAGUAUAGAUGU | 11139 | AcAcGuccAGuAuAGAuGudTsdT | sense |
| 2226-2245 | 9140 | ACAUCUAUACUGGACGUGU | 11140 | AcAUCuAuACUGGACGUGUdTsdT | antis |
| 2227-2246 | 9141 | CACGUCCAGUAUAGAUGUA | 11141 | cAcGuccAGuAuAGAuGuAdTsdT | sense |
| 2227-2246 | 9142 | UACAUCUAUACUGGACGUG | 11142 | uAcAUCuAuACUGGACGUGdTsdT | antis |
| 2276-2295 | 9143 | UUGCUAGGACAACCAAUAU | 11143 | uuGcuAGGAcAAccAAuAudTsdT | sense |
| 2276-2295 | 9144 | AUAUUGGUUGUCCUAGCAA | 11144 | AuAUUGGUUGUCCuAGcAAdTsdT | antis |
| 2277-2296 | 9145 | UGCUAGGACAACCAAUAUU | 11145 | uGcuAGGAcAAccAAuAuudTsdT | sense |
| 2277-2296 | 9146 | AAUAUUGGUUGUCCUAGCA | 11146 | AAuAUUGGUUGUCCuAGcAdTsdT | antis |
| 2279-2298 | 9147 | CUAGGACAACCAAUAUUUC | 11147 | cuAGGAcAAccAAuAuuucdTsdT | sense |
| 2279-2298 | 9148 | GAAAUAUUGGUUGUCCUAG | 11148 | GAAAuAUUGGUUGUCCuAGdTsdT | antis |
| 2306-2325 | 9149 | AGUGGUGUGGAUCAGUUGG | 11149 | AGuGGuGuGGAucAGuuGGdTsdT | sense |
| 2306-2325 | 9150 | CCAACUGAUCCACACCACU | 11150 | CcAACUGAUCcAcACcACUdTsdT | antis |
| 2488-2507 | 9151 | GGAGUACACACCUACCGCC | 11151 | GGAGuAcAcAccuAccGccdTsdT | sense |
| 2488-2507 | 9152 | GGCGGUAGGUGUGUACUCC | 11152 | GGCGGuAGGUGUGuACUCCdTsdT | antis |
| 2491-2510 | 9153 | GUACACACCUACCGCCCGG | 11153 | GuAcAcAccuAccGcccGGdTsdT | sense |
| 2491-2510 | 9154 | CCGGGCGGUAGGUGUGUAC | 11154 | CCGGGCGGuAGGUGUGuACdTsdT | antis |
| 2501-2520 | 9155 | ACCGCCCGGCUAACACCAC | 11155 | AccGcccGGcuAAcAccAcdTsdT | sense |
| 2501-2520 | 9156 | GUGGUGUUAGCCGGGCGGU | 11156 | GUGGUGUuAGCCGGGCGGUdTsdT | antis |
| 2506-2525 | 9157 | CCGGCUAACACCACUGGAA | 11157 | ccGGcuAAcAccAcuGGAAdTsdT | sense |
| 2506-2525 | 9158 | UUCCAGUGGUGUUAGCCGG | 11158 | UUCcAGUGGUGUuAGCCGGdTsdT | antis |
| 1695-1714 | 9159 | CAGACACGAAAGUGAUUGG | 11159 | cAGAcAcGAAAGuGAuuGGdTsdT | sense |
| 1695-1714 | 9160 | CCAAUCACUUUCGUGUCUG | 11160 | CcAAUcACUUUCGUGUCUGdTsdT | antis |
| 1720-1739 | 9161 | AUCAUUUGGUGUGGUAUAU | 11161 | AucAuuuGGuGuGGuAuAudTsdT | sense |
| 1720-1739 | 9162 | AUAUACCACACCAAAUGAU | 11162 | AuAuACcAcACcAAAUGAUdTsdT | antis |
| 1722-1741 | 9163 | CAUUUGGUGUGGUAUAUCA | 11163 | cAuuuGGuGuGGuAuAucAdTsdT | sense |
| 1722-1741 | 9164 | UGAUAUACCACACCAAAUG | 11164 | UGAuAuACcAcACcAAAUGdTsdT | antis |
| 1833-1852 | 9165 | AGCUAGACCACUGUAACAU | 11165 | AGcuAGAccAcuGuAAcAudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1833-1852 | 9166 | AUGUUACAGUGGUCUAGCU | 11166 | AUGUuAcAGUGGUCuAGCUdTsdT | antis |
| 1848-1867 | 9167 | ACAUAGUCCGACUGCGGUA | 11167 | AcAuAGuccGAcuGcGGuAdTsdT | sense |
| 1848-1867 | 9168 | UACCGCAGUCGGACUAUGU | 11168 | uACCGcAGUCGGACuAUGUdTsdT | antis |
| 1872-1891 | 9169 | UCUACUCGAGUGGUGAGAA | 11169 | ucuAcucGAGuGGuGAGAAdTsdT | sense |
| 1872-1891 | 9170 | UUCUCACCACUCGAGUAGA | 11170 | UUCUcACcACUCGAGuAGAdTsdT | antis |
| 1998-2017 | 9171 | UCAAGUUGUAUAUGUAUCA | 11171 | ucAAGuuGuAuAuGuAucAdTsdT | sense |
| 1998-2017 | 9172 | UGAUACAUAUACAACUUGA | 11172 | UGAuAcAuAuAcAACUUGAdTsdT | antis |
| 2011-2030 | 9173 | GUAUCAGCUGUUCAGAAGU | 11173 | GuAucAGcuGuucAGAAGudTsdT | sense |
| 2011-2030 | 9174 | ACUUCUGAACAGCUGAUAC | 11174 | ACUUCUGAAcAGCUGAuACdTsdT | antis |
| 2054-2073 | 9175 | AUCUGCCAUCGAGACAUUA | 11175 | AucuGccAucGAGAcAuuAdTsdT | sense |
| 2054-2073 | 9176 | UAAUGUCUCGAUGGCAGAU | 11176 | uAAUGUCUCGAUGGcAGAUdTsdT | antis |
| 2153-2172 | 9177 | GGAGAGCCCAAUGUUUCAU | 11177 | GGAGAGcccAAuGuuucAudTsdT | sense |
| 2153-2172 | 9178 | AUGAAACAUUGGGCUCUCC | 11178 | AUGAAAcAUUGGGCUCUCCdTsdT | antis |
| 2168-2187 | 9179 | UCAUAUAUCUGUUCUCGGU | 11179 | ucAuAuAucuGuucucGGudTsdT | sense |
| 2168-2187 | 9180 | ACCGAGAACAGAUAUAUGA | 11180 | ACCGAGAAcAGAuAuAUGAdTsdT | antis |
| 2181-2200 | 9181 | CUCGGUACUACAGGGCACC | 11181 | cucGGuAcuAcAGGGcAccdTsdT | sense |
| 2181-2200 | 9182 | GGUGCCCUGUAGUACCGAG | 11182 | GGUGCCCUGuAGuACCGAGdTsdT | antis |
| 2305-2324 | 9183 | CAGUGGUGUGGAUCAGUUG | 11183 | cAGuGGuGuGGAucAGuuGdTsdT | sense |
| 2305-2324 | 9184 | CAACUGAUCCACACCACUG | 11184 | cAACUGAUCcAcAccACUGdTsdT | antis |
| 2354-2373 | 9185 | ACAAGGGAGCAAAUUAGAG | 11185 | AcAAGGGAGcAAAuuAGAGdTsdT | sense |
| 2354-2373 | 9186 | CUCUAAUUUGCUCCCUUGU | 11186 | CUCuAAUUUGCUCCCUUGUdTsdT | antis |
| 2427-2446 | 9187 | GGACAAAGGUCUUCCGGCC | 11187 | GGAcAAAGGucuuccGGccdTsdT | sense |
| 2427-2446 | 9188 | GGCCGGAAGACCUUUGUCC | 11188 | GGCCGGAAGACCUUUGUCCdTsdT | antis |
| 1529-1548 | 9189 | UCGGGGCGACCGAGAACCA | 11189 | ucGGGGcGAccGAGAAccAdTsdT | sense |
| 1529-1548 | 9190 | UGGUUCUCGGUCGCCCCGA | 11190 | UGGUUCUCGGUCGCCCCGAdTsdT | antis |
| 1532-1551 | 9191 | GGGCGACCGAGAACCACCU | 11191 | GGGcGAccGAGAAccAccudTsdT | sense |
| 1532-1551 | 9192 | AGGUGGUUCUCGGUCGCCC | 11192 | AGGUGGUUCUCGGUCGCCCdTsdT | antis |
| 1541-1560 | 9193 | AGAACCACCUCCUUUGCGG | 11193 | AGAAccAccuccuuuGcGGdTsdT | sense |
| 1541-1560 | 9194 | CCGCAAAGGAGGUGGUUCU | 11194 | CCGcAAAGGAGGUGGUUCUdTsdT | antis |
| 1591-1610 | 9195 | UUUUGGUAGCAUGAAAGUU | 11195 | uuuuGGuAGcAuGAAAGuudTsdT | sense |
| 1591-1610 | 9196 | AACUUUCAUGCUACCAAAA | 11196 | AACUUUcAUGCuACcAAAAdTsdT | antis |
| 1677-1696 | 9197 | CACAGGAAGUCAGUUAUAC | 11197 | cAcAGGAAGucAGuuAuAcdTsdT | sense |
| 1677-1696 | 9198 | GUAUAACUGACUUCCUGUG | 11198 | GuAuAACUGACUUCCUGUGdTsdT | antis |
| 1679-1698 | 9199 | CAGGAAGUCAGUUAUACAG | 11199 | cAGGAAGucAGuuAuAcAGdTsdT | sense |
| 1679-1698 | 9200 | CUGUAUAACUGACUUCCUG | 11200 | CUGuAuAACUGACUUCCUGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1680-1699 | 9201 | AGGAAGUCAGUUAUACAGA | 11201 | AGGAAGucAGuuAuAcAGAdTsdT | sense |
| 1680-1699 | 9202 | UCUGUAUAACUGACUUCCU | 11202 | UCUGuAuAACUGACUUCCUdTsdT | antis |
| 1681-1700 | 9203 | GGAAGUCAGUUAUACAGAC | 11203 | GGAAGucAGuuAuAcAGAcdTsdT | sense |
| 1681-1700 | 9204 | GUCUGUAUAACUGACUUCC | 11204 | GUCUGuAuAACUGACUUCCdTsdT | antis |
| 1705-1724 | 9205 | AGUGAUUGGAAAUGGAUCA | 11205 | AGuGAuuGGAAAuGGAucAdTsdT | sense |
| 1705-1724 | 9206 | UGAUCCAUUUCCAAUCACU | 11206 | UGAUCcAUUUCcAAUcACUdTsdT | antis |
| 1706-1725 | 9207 | GUGAUUGGAAAUGGAUCAU | 11207 | GuGAuuGGAAAuGGAucAudTsdT | sense |
| 1706-1725 | 9208 | AUGAUCCAUUUCCAAUCAC | 11208 | AUGAUCcAUUUCcAAUcACdTsdT | antis |
| 1708-1727 | 9209 | GAUUGGAAAUGGAUCAUUU | 11209 | GAuuGGAAAuGGAucAuuudTsdT | sense |
| 1708-1727 | 9210 | AAAUGAUCCAUUUCCAAUC | 11210 | AAAUGAUCcAUUUCcAAUCdTsdT | antis |
| 1724-1743 | 9211 | UUUGGUGUGGUAUAUCAAG | 11211 | uuuGGuGuGGuAuAucAAGdTsdT | sense |
| 1724-1743 | 9212 | CUUGAUAUACCACACCAAA | 11212 | CUUGAuAuACcAcACcAAAdTsdT | antis |
| 1725-1744 | 9213 | UUGGUGUGGUAUAUCAAGC | 11213 | uuGGuGuGGuAuAucAAGcdTsdT | sense |
| 1725-1744 | 9214 | GCUUGAUAUACCACACCAA | 11214 | GCUUGAuAuACcAcACcAAdTsdT | antis |
| 1727-1746 | 9215 | GGUGUGGUAUAUCAAGCCA | 11215 | GGuGuGGuAuAucAAGccAdTsdT | sense |
| 1727-1746 | 9216 | UGGCUUGAUAUACCACACC | 11216 | UGGCUUGAuAuACcAcACCdTsdT | antis |
| 1739-1758 | 9217 | CAAGCCAAACUUUGUGAUU | 11217 | cAAGccAAAcuuuGuGAuudTsdT | sense |
| 1739-1758 | 9218 | AAUCACAAAGUUUGGCUUG | 11218 | AAUcAcAAAGUUUGGCUUGdTsdT | antis |
| 1785-1804 | 9219 | UUCUACAGGACAAGCGAUU | 11219 | uucuAcAGGAcAAGcGAuudTsdT | sense |
| 1785-1804 | 9220 | AAUCGCUUGUCCUGUAGAA | 11220 | AAUCGCUUGUCCUGuAGAAdTsdT | antis |
| 1828-1847 | 9221 | GAGAAAGCUAGACCACUGU | 11221 | GAGAAAGcuAGAccAcuGudTsdT | sense |
| 1828-1847 | 9222 | ACAGUGGUCUAGCUUUCUC | 11222 | AcAGUGGUCuAGCUUUCUCdTsdT | antis |
| 1829-1848 | 9223 | AGAAAGCUAGACCACUGUA | 11223 | AGAAAGcuAGAccAcuGuAdTsdT | sense |
| 1829-1848 | 9224 | UACAGUGGUCUAGCUUUCU | 11224 | uAcAGUGGUCuAGCUUUCUdTsdT | antis |
| 1837-1856 | 9225 | AGACCACUGUAACAUAGUC | 11225 | AGAccAcuGuAAcAuAGucdTsdT | sense |
| 1837-1856 | 9226 | GACUAUGUUACAGUGGUCU | 11226 | GACuAUGUuAcAGUGGUCUdTsdT | antis |
| 1839-1858 | 9227 | ACCACUGUAACAUAGUCCG | 11227 | AccAcuGuAAcAuAGuccGdTsdT | sense |
| 1839-1858 | 9228 | CGGACUAUGUUACAGUGGU | 11228 | CGGACuAUGUuAcAGUGGUdTsdT | antis |
| 1841-1860 | 9229 | CACUGUAACAUAGUCCGAC | 11229 | cAcuGuAAcAuAGuccGAcdTsdT | sense |
| 1841-1860 | 9230 | GUCGGACUAUGUUACAGUG | 11230 | GUCGGACuAUGUuAcAGUGdTsdT | antis |
| 1864-1883 | 9231 | GUAUUUCUUCUACUCGAGU | 11231 | GuAuuucuucuAcucGAGudTsdT | sense |
| 1864-1883 | 9232 | ACUCGAGUAGAAGAAAUAC | 11232 | ACUCGAGuAGAAGAAAuACdTsdT | antis |
| 1865-1884 | 9233 | UAUUUCUUCUACUCGAGUG | 11233 | uAuuucuucuAcucGAGuGdTsdT | sense |
| 1865-1884 | 9234 | CACUCGAGUAGAAGAAAUA | 11234 | cACUCGAGuAGAAGAAAuAdTsdT | antis |
| 1867-1886 | 9235 | UUUCUUCUACUCGAGUGGU | 11235 | uuucuucuAcucGAGuGGudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1867-1886 | 9236 | ACCACUCGAGUAGAAGAAA | 11236 | ACcACUCGAGuAGAAGAAAdTsdT | antis |
| 1874-1893 | 9237 | UACUCGAGUGGUGAGAAGA | 11237 | uAcucGAGuGGuGAGAAGAdTsdT | sense |
| 1874-1893 | 9238 | UCUUCUCACCACUCGAGUA | 11238 | UCUUCUcACcACUCGAGuAdTsdT | antis |
| 1894-1913 | 9239 | AGAUGAGGUCUACCUUAAC | 11239 | AGAuGAGGucuAccuuAAcdTsdT | sense |
| 1894-1913 | 9240 | GUUAAGGUAGACCUCAUCU | 11240 | GUuAAGGuAGACCUcAUCUdTsdT | antis |
| 1921-1940 | 9241 | GGACUAUGUUCCGGAGACA | 11241 | GGAcuAuGuuccGGAGAcAdTsdT | sense |
| 1921-1940 | 9242 | UGUCUCCGGAACAUAGUCC | 11242 | UGUCUCCGGAAcAuAGUCCdTsdT | antis |
| 1954-1973 | 9243 | CAGACACUAUAGUCGAGCC | 11243 | cAGAcAcuAuAGucGAGccdTsdT | sense |
| 1954-1973 | 9244 | GGCUCGACUAUAGUGUCUG | 11244 | GGCUCGACuAuAGUGUCUGdTsdT | antis |
| 2006-2025 | 9245 | UAUAUGUAUCAGCUGUUCA | 11245 | uAuAuGuAucAGcuGuucAdTsdT | sense |
| 2006-2025 | 9246 | UGAACAGCUGAUACAUAUA | 11246 | UGAAcAGCUGAuAcAuAuAdTsdT | antis |
| 2017-2036 | 9247 | GCUGUUCAGAAGUCUAGCC | 11247 | GcuGuucAGAAGucuAGccdTsdT | sense |
| 2017-2036 | 9248 | GGCUAGACUUCUGAACAGC | 11248 | GGCuAGACUUCUGAAcAGCdTsdT | antis |
| 2019-2038 | 9249 | UGUUCAGAAGUCUAGCCUA | 11249 | uGuucAGAAGucuAGccuAdTsdT | sense |
| 2019-2038 | 9250 | UAGGCUAGACUUCUGAACA | 11250 | uAGGCuAGACUUCUGAAcAdTsdT | antis |
| 2026-2045 | 9251 | AAGUCUAGCCUAUAUCCAU | 11251 | AAGucuAGccuAuAuccAudTsdT | sense |
| 2026-2045 | 9252 | AUGGAUAUAGGCUAGACUU | 11252 | AUGGAuAuAGGCuAGACUUdTsdT | antis |
| 2052-2071 | 9253 | GAAUCUGCCAUCGAGACAU | 11253 | GAAucuGccAucGAGAcAudTsdT | sense |
| 2052-2071 | 9254 | AUGUCUCGAUGGCAGAUUC | 11254 | AUGUCUCGAUGGcAGAUUCdTsdT | antis |
| 2072-2091 | 9255 | AAACCACAGAACCUCUUGU | 11255 | AAAccAcAGAAccucuuGudTsdT | sense |
| 2072-2091 | 9256 | ACAAGAGGUUCUGUGGUUU | 11256 | AcAAGAGGUUCUGUGGUUUdTsdT | antis |
| 2082-2101 | 9257 | ACCUCUUGUUGGAUCCUGA | 11257 | AccucuuGuuGGAuccuGAdTsdT | sense |
| 2082-2101 | 9258 | UCAGGAUCCAACAAGAGGU | 11258 | UcAGGAUCcAAcAAGAGGUdTsdT | antis |
| 2088-2107 | 9259 | UGUUGGAUCCUGAUACAGC | 11259 | uGuuGGAuccuGAuAcAGcdTsdT | sense |
| 2088-2107 | 9260 | GCUGUAUCAGGAUCCAACA | 11260 | GCUGuAUcAGGAUCcAAcAdTsdT | antis |
| 2096-2115 | 9261 | CCUGAUACAGCUGUAUUAA | 11261 | ccuGAuAcAGcuGuAuuAAdTsdT | sense |
| 2096-2115 | 9262 | UUAAUACAGCUGUAUCAGG | 11262 | UuAAuAcAGCUGuAUcAGGdTsdT | antis |
| 2167-2186 | 9263 | UUCAUAUAUCUGUUCUCGG | 11263 | uucAuAuAucuGuucucGGdTsdT | sense |
| 2167-2186 | 9264 | CCGAGAACAGAUAUAUGAA | 11264 | CCGAGAAcAGAuAuAUGAAdTsdT | antis |
| 2192-2211 | 9265 | AGGGCACCAGAGUUGAUCU | 11265 | AGGGcAccAGAGuuGAucudTsdT | sense |
| 2192-2211 | 9266 | AGAUCAACUCUGGUGCCCU | 11266 | AGAUcAACUCUGGUGCCCUdTsdT | antis |
| 2213-2232 | 9267 | GGAGCCACUGAUUACACGU | 11267 | GGAccAcuGAuuAcAcGudTsdT | sense |
| 2213-2232 | 9268 | ACGUGUAAUCAGUGGCUCC | 11268 | ACGUGuAAUcAGUGGCUCCdTsdT | antis |
| 2214-2233 | 9269 | GAGCCACUGAUUACACGUC | 11269 | GAGccAcuGAuuAcAcGucdTsdT | sense |
| 2214-2233 | 9270 | GACGUGUAAUCAGUGGCUC | 11270 | GACGUGuAAUcAGUGGCUCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2225-2244 | 9271 | UACACGUCCAGUAUAGAUG | 11271 | uAcAcGuccAGuAuAGAuGdTsdT | sense |
| 2225-2244 | 9272 | CAUCUAUACUGGACGUGUA | 11272 | cAUCuAuACUGGACGUGUAdTsdT | antis |
| 2229-2248 | 9273 | CGUCCAGUAUAGAUGUAUG | 11273 | cGuccAGuAuAGAuGuAuGdTsdT | sense |
| 2229-2248 | 9274 | CAUACAUCUAUACUGGACG | 11274 | cAuAcAUCuAuACUGGACGdTsdT | antis |
| 2230-2249 | 9275 | GUCCAGUAUAGAUGUAUGG | 11275 | GuccAGuAuAGAuGuAuGGdTsdT | sense |
| 2230-2249 | 9276 | CCAUACAUCUAUACUGGAC | 11276 | CcAuAcAUCuAuACUGGACdTsdT | antis |
| 2233-2252 | 9277 | CAGUAUAGAUGUAUGGUCU | 11277 | cAGuAuAGAuGuAuGGucudTsdT | sense |
| 2233-2252 | 9278 | AGACCAUACAUCUAUACUG | 11278 | AGACcAuAcAUCuAuACUGdTsdT | antis |
| 2236-2255 | 9279 | UAUAGAUGUAUGGUCUGCA | 11279 | uAuAGAuGuAuGGucuGcAdTsdT | sense |
| 2236-2255 | 9280 | UGCAGACCAUACAUCUAUA | 11280 | UGcAGACcAuAcAUCuAuAdTsdT | antis |
| 2239-2258 | 9281 | AGAUGUAUGGUCUGCAGGC | 11281 | AGAuGuAuGGucuGcAGGcdTsdT | sense |
| 2239-2258 | 9282 | GCCUGCAGACCAUACAUCU | 11282 | GCCUGcAGACcAuAcAUCUdTsdT | antis |
| 2268-2287 | 9283 | CUGAAUUGUUGCUAGGACA | 11283 | cuGAAuuGuuGcuAGGAcAdTsdT | sense |
| 2268-2287 | 9284 | UGUCCUAGCAACAAUUCAG | 11284 | UGUCCuAGcAAcAAUUcAGdTsdT | antis |
| 2278-2297 | 9285 | GCUAGGACAACCAAUAUUU | 11285 | GcuAGGAcAAccAAuAuuudTsdT | sense |
| 2278-2297 | 9286 | AAAUAUUGGUUGUCCUAGC | 11286 | AAAuAUUGGUUGUCCuAGCdTsdT | antis |
| 2286-2305 | 9287 | AACCAAUAUUUCCUGGGGA | 11287 | AAccAAuAuuuccuGGGGAdTsdT | sense |
| 2286-2305 | 9288 | UCCCCAGGAAAUAUUGGUU | 11288 | UCCCcAGGAAAuAUUGGUUdTsdT | antis |
| 2339-2358 | 9289 | GUCCUAGGAACACCAACAA | 11289 | GuccuAGGAAcAccAAcAAdTsdT | sense |
| 2339-2358 | 9290 | UUGUUGGUGUUCCUAGGAC | 11290 | UUGUUGGUGUUCCuAGGACdTsdT | antis |
| 2340-2359 | 9291 | UCCUAGGAACACCAACAAG | 11291 | uccuAGGAAcAccAAcAAGdTsdT | sense |
| 2340-2359 | 9292 | CUUGUUGGUGUUCCUAGGA | 11292 | CUUGUUGGUGUUCCuAGGAdTsdT | antis |
| 2342-2361 | 9293 | CUAGGAACACCAACAAGGG | 11293 | cuAGGAAcAccAAcAAGGGdTsdT | sense |
| 2342-2361 | 9294 | CCCUUGUUGGUGUUCCUAG | 11294 | CCCUUGUUGGUGUUCCuAGdTsdT | antis |
| 2344-2363 | 9295 | AGGAACACCAACAAGGGAG | 11295 | AGGAAcAccAAcAAGGGAGdTsdT | sense |
| 2344-2363 | 9296 | CUCCCUUGUUGGUGUUCCU | 11296 | CUCCCUUGUUGGUGUUCCUdTsdT | antis |
| 2355-2374 | 9297 | CAAGGGAGCAAAUUAGAGA | 11297 | cAAGGGAGcAAAuuAGAGAdTsdT | sense |
| 2355-2374 | 9298 | UCUCUAAUUUGCUCCCUUG | 11298 | UCUCuAAUUUGCUCCCUUGdTsdT | antis |
| 2397-2416 | 9299 | UCAAAUUCCCUCAAAUCAA | 11299 | ucAAAuucccucAAAucAAdTsdT | sense |
| 2397-2416 | 9300 | UUGAUUUGAGGGAAUUUGA | 11300 | UUGAUUUGAGGGAAUUUGAdTsdT | antis |
| 2434-2453 | 9301 | GGUCUUCCGGCCCCGAACU | 11301 | GGucuuccGGccccGAAcudTsdT | sense |
| 2434-2453 | 9302 | AGUUCGGGGCCGGAAGACC | 11302 | AGUUCGGGGCCGGAAGACCdTsdT | antis |
| 2435-2454 | 9303 | GUCUUCCGGCCCCGAACUC | 11303 | GucuuccGGccccGAAcucdTsdT | sense |
| 2435-2454 | 9304 | GAGUUCGGGGCCGGAAGAC | 11304 | GAGUUCGGGGCCGGAAGACdTsdT | antis |
| 2437-2456 | 9305 | CUUCCGGCCCCGAACUCCA | 11305 | cuuccGGccccGAAcuccAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2437-2456 | 9306 | UGGAGUUCGGGGCCGGAAG | 11306 | UGGAGUUCGGGGCCGGAAGdTsdT | antis |
| 2453-2472 | 9307 | CCACCAGAGGCAAUUGCAC | 11307 | ccAccAGAGGcAAuuGcAcdTsdT | sense |
| 2453-2472 | 9308 | GUGCAAUUGCCUCUGGUGG | 11308 | GUGcAAUUGCCUCUGGUGGdTsdT | antis |
| 2467-2486 | 9309 | UGCACUGUGCAGCCGUCUG | 11309 | uGcAcuGuGcAGccGucuGdTsdT | sense |
| 2467-2486 | 9310 | CAGACGGCUGCACAGUGCA | 11310 | cAGACGGCUGcAcAGUGcAdTsdT | antis |
| 2486-2505 | 9311 | CUGGAGUACACACCUACCG | 11311 | cuGGAGuAcAcAccuAccGdTsdT | sense |
| 2486-2505 | 9312 | CGGUAGGUGUGUACUCCAG | 11312 | CGGuAGGUGUGuACUCcAGdTsdT | antis |
| 2490-2509 | 9313 | AGUACACACCUACCGCCCG | 11313 | AGuAcAcAccuAccGcccGdTsdT | sense |
| 2490-2509 | 9314 | CGGGCGGUAGGUGUGUACU | 11314 | CGGGCGGuAGGUGUGuACUdTsdT | antis |
| 2505-2524 | 9315 | CCCGGCUAACACCACUGGA | 11315 | cccGGcuAAcAccAcuGGAdTsdT | sense |
| 2505-2524 | 9316 | UCCAGUGGUGUUAGCCGGG | 11316 | UCcAGUGGUGUuAGCCGGGdTsdT | antis |
| 2508-2527 | 9317 | GGCUAACACCACUGGAAGC | 11317 | GGcuAAcAccAcuGGAAGcdTsdT | sense |
| 2508-2527 | 9318 | GCUUCCAGUGGUGUUAGCC | 11318 | GCUUCcAGUGGUGUuAGCCdTsdT | antis |
| 1938-1957 | 9319 | CAGUGUACAGAGUCGCCAG | 11319 | cAGuGuAcAGAGucGccAGdTsdT | sense |
| 1938-1957 | 9320 | CUGGCGACUCUGUACACUG | 11320 | CUGGCGACUCUGuAcACUGdTsdT | antis |
| 1985-2004 | 9321 | CCUGUGAUCUAUGUCAAGU | 11321 | ccuGuGAucuAuGucAAGudTsdT | sense |
| 1985-2004 | 9322 | ACUUGACAUAGAUCACAGG | 11322 | ACUUGAcAuAGAUcAcAGGdTsdT | antis |
| 2164-2183 | 9323 | UGUUUCAUAUAUCUGUUCU | 11323 | uGuuucAuAuAucuGuucudTsdT | sense |
| 2164-2183 | 9324 | AGAACAGAUAUAUGAAACA | 11324 | AGAAcAGAuAuAUGAAAcAdTsdT | antis |
| 2263-2282 | 9325 | GUUGGCUGAAUUGUUGCUA | 11325 | GuuGGcuGAAuuGuuGcuAdTsdT | sense |
| 2263-2282 | 9326 | UAGCAACAAUUCAGCCAAC | 11326 | uAGcAAcAAUUcAGCcAACdTsdT | antis |
| 2367-2386 | 9327 | UUAGAGAAAUGAACCCAAA | 11327 | uuAGAGAAAuGAAcccAAAdTsdT | sense |
| 2367-2386 | 9328 | UUUGGGUUCAUUUCUCUAA | 11328 | UUUGGGUUcAUUUCUCuAAdTsdT | antis |
| 2395-2414 | 9329 | AUUCAAAUUCCCUCAAAUC | 11329 | AuucAAAuucccucAAAucdTsdT | sense |
| 2395-2414 | 9330 | GAUUUGAGGGAAUUUGAAU | 11330 | GAUUUGAGGGAAUUUGAAUdTsdT | antis |
| 1624-1643 | 9331 | UGGCAGCAAGGUAACCACA | 11331 | uGGcAGcAAGGuAAccAcAdTsdT | sense |
| 1624-1643 | 9332 | UGUGGUUACCUUGCUGCCA | 11332 | UGUGGUuACCUUGCUGCcAdTsdT | antis |
| 1686-1705 | 9333 | UCAGUUAUACAGACACGAA | 11333 | ucAGuuAuAcAGAcAcGAAdTsdT | sense |
| 1686-1705 | 9334 | UUCGUGUCUGUAUAACUGA | 11334 | UUCGUGUCUGuAuAACUGAdTsdT | antis |
| 1979-1998 | 9335 | ACACUCCCUGUGAUCUAUG | 11335 | AcAcucccuGuGAucuAuGdTsdT | sense |
| 1979-1998 | 9336 | CAUAGAUCACAGGGAGUGU | 11336 | cAuAGAUcAcAGGGAGUGUdTsdT | antis |
| 2080-2099 | 9337 | GAACCUCUUGUUGGAUCCU | 11337 | GAAccucuuGuuGGAuccudTsdT | sense |
| 2080-2099 | 9338 | AGGAUCCAACAAGAGGUUC | 11338 | AGGAUCcAAcAAGAGGUUCdTsdT | antis |
| 2091-2110 | 9339 | UGGAUCCUGAUACAGCUGU | 11339 | uGGAuccuGAuAcAGcuGudTsdT | sense |
| 2091-2110 | 9340 | ACAGCUGUAUCAGGAUCCA | 11340 | AcAGCUGuAUcAGGAUCcAdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
| --- | --- | --- | --- | --- | --- |
| 2162-2181 | 9341 | AAUGUUUCAUAUAUCUGUU | 11341 | AAuGuuucAuAuAucuGuudTsdT | sense |
| 2162-2181 | 9342 | AACAGAUAUAUGAAACAUU | 11342 | AAcAGAuAuAUGAAAcAUUdTsdT | antis |
| 2175-2194 | 9343 | UCUGUUCUCGGUACUACAG | 11343 | ucuGuucucGGuAcuAcAGdTsdT | sense |
| 2175-2194 | 9344 | CUGUAGUACCGAGAACAGA | 11344 | CUGuAGuACCGAGAAcAGAdTsdT | antis |
| 2267-2286 | 9345 | GCUGAAUUGUUGCUAGGAC | 11345 | GcuGAAuuGuuGcuAGGAcdTsdT | sense |
| 2267-2286 | 9346 | GUCCUAGCAACAAUUCAGC | 11346 | GUCCuAGcAAcAAUUcAGCdTsdT | antis |
| 2309-2328 | 9347 | GGUGUGGAUCAGUUGGUGG | 11347 | GGuGuGGAucAGuuGGuGGdTsdT | sense |
| 2309-2328 | 9348 | CCACCAACUGAUCCACACC | 11348 | CcACcAACUGAUCcAcACCdTsdT | antis |
| 2451-2470 | 9349 | CUCCACCAGAGGCAAUUGC | 11349 | cuccAccAGAGGcAAuuGcdTsdT | sense |
| 2451-2470 | 9350 | GCAAUUGCCUCUGGUGGAG | 11350 | GcAAUUGCCUCUGGUGGAGdTsdT | antis |
| 1546-1565 | 9351 | CACCUCCUUUGCGGAGAGC | 11351 | cAccuccuuuGcGGAGAGcdTsdT | sense |
| 1546-1565 | 9352 | GCUCUCCGCAAAGGAGGUG | 11352 | GCUCUCCGcAAAGGAGGUGdTsdT | antis |
| 1936-1955 | 9353 | GACAGUGUACAGAGUCGCC | 11353 | GAcAGuGuAcAGAGucGccdTsdT | sense |
| 1936-1955 | 9354 | GGCGACUCUGUACACUGUC | 11354 | GGCGACUCUGuAcACUGUCdTsdT | antis |
| 1592-1611 | 9355 | UUUGGUAGCAUGAAAGUUA | 11355 | uuuGGuAGcAuGAAAGuuAdTsdT | sense |
| 1592-1611 | 9356 | UAACUUUCAUGCUACCAAA | 11356 | uAACUUUcAUGCuACcAAAdTsdT | antis |
| 1620-1639 | 9357 | AAGAUGGCAGCAAGGUAAC | 11357 | AAGAuGGcAGcAAGGuAAcdTsdT | sense |
| 1620-1639 | 9358 | GUUACCUUGCUGCCAUCUU | 11358 | GUuACCUUGCUGCcAUCUUdTsdT | antis |
| 1675-1694 | 9359 | GCCACAGGAAGUCAGUUAU | 11359 | GccAcAGGAAGucAGuuAudTsdT | sense |
| 1675-1694 | 9360 | AUAACUGACUUCCUGUGGC | 11360 | AuAACUGACUUCCUGUGGCdTsdT | antis |
| 1723-1742 | 9361 | AUUUGGUGUGGUAUAUCAA | 11361 | AuuuGGuGuGGuAuAucAAdTsdT | sense |
| 1723-1742 | 9362 | UUGAUAUACCACACCAAAU | 11362 | UUGAuAuACcAcACcAAAUdTsdT | antis |
| 1738-1757 | 9363 | UCAAGCCAAACUUUGUGAU | 11363 | ucAAGccAAAcuuuGuGAudTsdT | sense |
| 1738-1757 | 9364 | AUCACAAAGUUUGGCUUGA | 11364 | AUcAcAAAGUUUGGCUUGAdTsdT | antis |
| 1758-1777 | 9365 | CUGGAGAACUGGUUGCCAU | 11365 | cuGGAGAAcuGGuuGccAudTsdT | sense |
| 1758-1777 | 9366 | AUGGCAACCAGUUCUCCAG | 11366 | AUGGcAACcAGUUCUCcAGdTsdT | antis |
| 2027-2046 | 9367 | AGUCUAGCCUAUAUCCAUU | 11367 | AGucuAGccuAuAuccAuudTsdT | sense |
| 2027-2046 | 9368 | AAUGGAUAUAGGCUAGACU | 11368 | AAUGGAuAuAGGCuAGACUdTsdT | antis |
| 2083-2102 | 9369 | CCUCUUGUUGGAUCCUGAU | 11369 | ccucuuGuuGGAuccuGAudTsdT | sense |
| 2083-2102 | 9370 | AUCAGGAUCCAACAAGAGG | 11370 | AUcAGGAUCcAAcAAGAGGdTsdT | antis |
| 2097-2116 | 9371 | CUGAUACAGCUGUAUUAAA | 11371 | cuGAuAcAGcuGuAuuAAAdTsdT | sense |
| 2097-2116 | 9372 | UUUAAUACAGCUGUAUCAG | 11372 | UUuAAuAcAGCUGuAUcAGdTsdT | antis |
| 2104-2123 | 9373 | AGCUGUAUUAAAACUCUGU | 11373 | AGcuGuAuuAAAAcucuGudTsdT | sense |
| 2104-2123 | 9374 | ACAGAGUUUUAAUACAGCU | 11374 | AcAGAGUUuAAuAcAGCUdTsdT | antis |
| 2208-2227 | 9375 | UCUUUGGAGCCACUGAUUA | 11375 | ucuuuGGAGccAcuGAuuAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2208-2227 | 9376 | UAAUCAGUGGCUCCAAAGA | 11376 | uAAUcAGUGGCUCcAAAGAdTsdT | antis |
| 2210-2229 | 9377 | UUUGGAGCCACUGAUUACA | 11377 | uuuGGAGccAcuGAuuAcAdTsdT | sense |
| 2210-2229 | 9378 | UGUAAUCAGUGGCUCCAAA | 11378 | UGuAAUcAGUGGCUCcAAAdTsdT | antis |
| 2304-2323 | 9379 | ACAGUGGUGUGGAUCAGUU | 11379 | AcAGuGGuGuGGAucAGuudTsdT | sense |
| 2304-2323 | 9380 | AACUGAUCCACACCACUGU | 11380 | AACUGAUCcAcACcACUGUdTsdT | antis |
| 2328-2347 | 9381 | AAAUAAUAAAGGUCCUAGG | 11381 | AAAuAAuAAAGGuccuAGGdTsdT | sense |
| 2328-2347 | 9382 | CCUAGGACCUUUAUUAUUU | 11382 | CCuAGGACCUUuAUuAUUUdTsdT | antis |
| 2390-2409 | 9383 | ACAGAAUUCAAAUUCCCUC | 11383 | AcAGAAuucAAAuucccucdTsdT | sense |
| 2390-2409 | 9384 | GAGGGAAUUUGAAUUCUGU | 11384 | GAGGGAAUUUGAAUUCUGUdTsdT | antis |
| 2018-2037 | 9385 | CUGUUCAGAAGUCUAGCCU | 11385 | cuGuucAGAAGucuAGccudTsdT | sense |
| 2018-2037 | 9386 | AGGCUAGACUUCUGAACAG | 11386 | AGGCuAGACUUCUGAAcAGdTsdT | antis |
| 2338-2357 | 9387 | GGUCCUAGGAACACCAACA | 11387 | GGuccuAGGAAcAccAAcAdTsdT | sense |
| 2338-2357 | 9388 | UGUUGGUGUUCCUAGGACC | 11388 | UGUUGGUGUUCCuAGGACCdTsdT | antis |
| 2351-2370 | 9389 | CCAACAAGGGAGCAAAUUA | 11389 | ccAAcAAGGGAGcAAAuuAdTsdT | sense |
| 2351-2370 | 9390 | UAAUUUGCUCCCUUGUUGG | 11390 | uAAUUUGCUCCCUUGUUGGdTsdT | antis |
| 2433-2452 | 9391 | AGGUCUUCCGGCCCCGAAC | 11391 | AGGucuuccGGccccGAAcdTsdT | sense |
| 2433-2452 | 9392 | GUUCGGGGCCGGAAGACCU | 11392 | GUUCGGGGCCGGAAGACCUdTsdT | antis |
| 2180-2199 | 9393 | UCUCGGUACUACAGGGCAC | 11393 | ucucGGuAcuAcAGGGcAcdTsdT | sense |
| 2180-2199 | 9394 | GUGCCCUGUAGUACCGAGA | 11394 | GUGCCCUGuAGuACCGAGAdTsdT | antis |
| 1644-1663 | 9395 | UAGUGGCAACUCCUGGCCA | 11395 | uAGuGGcAAcuccuGGccAdTsdT | sense |
| 1644-1663 | 9396 | UGGCCAGGAGUUGCCACUA | 11396 | UGGCcAGGAGUUGCcACuAdTsdT | antis |
| 1827-1846 | 9397 | UGAGAAAGCUAGACCACUG | 11397 | uGAGAAAGcuAGAccAcuGdTsdT | sense |
| 1827-1846 | 9398 | CAGUGGUCUAGCUUUCUCA | 11398 | cAGUGGUCuAGCUUUCUcAdTsdT | antis |
| 2098-2117 | 9399 | UGAUACAGCUGUAUUAAAA | 11399 | uGAuAcAGcuGuAuuAAAAdTsdT | sense |
| 2098-2117 | 9400 | UUUUAAUACAGCUGUAUCA | 11400 | UUUuAAuAcAGCUGuAUcAdTsdT | antis |
| 2254-2273 | 9401 | AGGCUGUGUGUUGGCUGAA | 11401 | AGGcuGuGuGuuGGcuGAAdTsdT | sense |
| 2254-2273 | 9402 | UUCAGCCAACACACAGCCU | 11402 | UUcAGCcAAcAcAcAGCCUdTsdT | antis |
| 1674-1693 | 9403 | GGCCACAGGAAGUCAGUUA | 11403 | GGccAcAGGAAGucAGuuAdTsdT | sense |
| 1674-1693 | 9404 | UAACUGACUUCCUGUGGCC | 11404 | uAACUGACUUCCUGUGGCCdTsdT | antis |
| 2495-2514 | 9405 | ACACCUACCGCCCGGCUAA | 11405 | AcAccuAccGcccGGcuAAdTsdT | sense |
| 2495-2514 | 9406 | UUAGCCGGGCGGUAGGUGU | 11406 | UuAGCCGGGCGGuAGGUGUdTsdT | antis |
| 1794-1813 | 9407 | ACAAGCGAUUUAAGAACCG | 11407 | AcAAGcGAuuuAAGAAccGdTsdT | sense |
| 1794-1813 | 9408 | CGGUUCUUAAAUCGCUUGU | 11408 | CGGUUCUuAAAUCGCUUGUdTsdT | antis |
| 1861-1880 | 9409 | GCGGUAUUUCUUCUACUCG | 11409 | GcGGuAuucuucuAcucGdTsdT | sense |
| 1861-1880 | 9410 | CGAGUAGAAGAAAUACCGC | 11410 | CGAGuAGAAGAAAuACCGCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1989-2008 | 9411 | UGAUCUAUGUCAAGUUGUA | 11411 | uGAucuAuGucAAGuuGuAdTsdT | sense |
| 1989-2008 | 9412 | UACAACUUGACAUAGAUCA | 11412 | uAcAACUUGAcAuAGAUcAdTsdT | antis |
| 2025-2044 | 9413 | GAAGUCUAGCCUAUAUCCA | 11413 | GAAGucuAGccuAuAuccAdTsdT | sense |
| 2025-2044 | 9414 | UGGAUAUAGGCUAGACUUC | 11414 | UGGAuAuAGGCuAGACUUCdTsdT | antis |
| 2028-2047 | 9415 | GUCUAGCCUAUAUCCAUUC | 11415 | GucuAGccuAuAuccAuucdTsdT | sense |
| 2028-2047 | 9416 | GAAUGGAUAUAGGCUAGAC | 11416 | GAAUGGAuAuAGGCuAGACdTsdT | antis |
| 2029-2048 | 9417 | UCUAGCCUAUAUCCAUUCC | 11417 | ucuAGccuAuAuccAuuccdTsdT | sense |
| 2029-2048 | 9418 | GGAAUGGAUAUAGGCUAGA | 11418 | GGAAUGGAuAuAGGCuAGAdTsdT | antis |
| 2275-2294 | 9419 | GUUGCUAGGACAACCAAUA | 11419 | GuuGcuAGGAcAAccAAuAdTsdT | sense |
| 2275-2294 | 9420 | UAUUGGUUGUCCUAGCAAC | 11420 | uAUUGGUUGUCCuAGcAACdTsdT | antis |
| 1593-1612 | 9421 | UUGGUAGCAUGAAAGUUAG | 11421 | uuGGuAGcAuGAAAGuuAGdTsdT | sense |
| 1593-1612 | 9422 | CUAACUUUCAUGCUACCAA | 11422 | CuAACUUUcAUGCuACcAAdTsdT | antis |
| 1690-1709 | 9423 | UUAUACAGACACGAAAGUG | 11423 | uuAuAcAGAcAcGAAAGuGdTsdT | sense |
| 1690-1709 | 9424 | CACUUUCGUGUCUGUAUAA | 11424 | cACUUUCGUGUCUGuAuAAdTsdT | antis |
| 1795-1814 | 9425 | CAAGCGAUUUAAGAACCGA | 11425 | cAAGcGAuuuAAGAAccGAdTsdT | sense |
| 1795-1814 | 9426 | UCGGUUCUUAAAUCGCUUG | 11426 | UCGGUUCUuAAAUCGCUUGdTsdT | antis |
| 1822-1841 | 9427 | GAUCAUGAGAAAGCUAGAC | 11427 | GAucAuGAGAAAGcuAGAcdTsdT | sense |
| 1822-1841 | 9428 | GUCUAGCUUUCUCAUGAUC | 11428 | GUCuAGCUUUCUcAUGAUCdTsdT | antis |
| 1901-1920 | 9429 | GUCUACCUUAACCUGGUGC | 11429 | GucuAccuuAAccuGGuGcdTsdT | sense |
| 1901-1920 | 9430 | GCACCAGGUUAAGGUAGAC | 11430 | GcACcAGGUuAAGGuAGACdTsdT | antis |
| 1926-1945 | 9431 | AUGUUCCGGAGACAGUGUA | 11431 | AuGuccGGAGAcAGuGuAdTsdT | sense |
| 1926-1945 | 9432 | UACACUGUCUCCGGAACAU | 11432 | uAcACUGUCUCCGGAAcAUdTsdT | antis |
| 1947-1966 | 9433 | GAGUCGCCAGACACUAUAG | 11433 | GAGucGccAGAcAcuAuAGdTsdT | sense |
| 1947-1966 | 9434 | CUAUAGUGUCUGGCGACUC | 11434 | CuAuAGUGUCUGGCGACUCdTsdT | antis |
| 1949-1968 | 9435 | GUCGCCAGACACUAUAGUC | 11435 | GucGccAGAcAcuAuAGucdTsdT | sense |
| 1949-1968 | 9436 | GACUAUAGUGUCUGGCGAC | 11436 | GACuAuAGUGUCUGGCGACdTsdT | antis |
| 1956-1975 | 9437 | GACACUAUAGUCGAGCCAA | 11437 | GAcAcuAuAGucGAGccAAdTsdT | sense |
| 1956-1975 | 9438 | UUGGCUCGACUAUAGUGUC | 11438 | UUGGCUCGACuAuAGUGUCdTsdT | antis |
| 1977-1996 | 9439 | AGACACUCCCUGUGAUCUA | 11439 | AGAcAcucccuGuGAucuAdTsdT | sense |
| 1977-1996 | 9440 | UAGAUCACAGGGAGUGUCU | 11440 | uAGAUcAcAGGGAGUGUCUdTsdT | antis |
| 1990-2009 | 9441 | GAUCUAUGUCAAGUUGUAU | 11441 | GAucuAuGucAAGuuGuAudTsdT | sense |
| 1990-2009 | 9442 | AUACAACUUGACAUAGAUC | 11442 | AuAcAACUUGAcAuAGAUCdTsdT | antis |
| 2008-2027 | 9443 | UAUGUAUCAGCUGUUCAGA | 11443 | uAuGuAucAGcuGuucAGAdTsdT | sense |
| 2008-2027 | 9444 | UCUGAACAGCUGAUACAUA | 11444 | UCUGAAcAGCUGAuAcAuAdTsdT | antis |
| 2047-2066 | 9445 | CUUUGGAAUCUGCCAUCGA | 11445 | cuuuGGAAucuGccAucGAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2047-2066 | 9446 | UCGAUGGCAGAUUCCAAAG | 11446 | UCGAUGGcAGAUUCcAAAGdTsdT | antis |
| 2187-2206 | 9447 | ACUACAGGGCACCAGAGUU | 11447 | AcuAcAGGGcAccAGAGuudTsdT | sense |
| 2187-2206 | 9448 | AACUCUGGUGCCCUGUAGU | 11448 | AACUCUGGUGCCCUGuAGUdTsdT | antis |
| 2307-2326 | 9449 | GUGGUGUGGAUCAGUUGGU | 11449 | GuGGuGuGGAucAGuuGGudTsdT | sense |
| 2307-2326 | 9450 | ACCAACUGAUCCACACCAC | 11450 | ACcAACUGAUCcAcACcACdTsdT | antis |
| 2357-2376 | 9451 | AGGGAGCAAAUUAGAGAAA | 11451 | AGGGAGcAAAuuAGAGAAAdTsdT | sense |
| 2357-2376 | 9452 | UUUCUCUAAUUUGCUCCCU | 11452 | UUUCUCuAAUUUGCUCCCUdTsdT | antis |
| 2405-2424 | 9453 | CCUCAAAUCAAGGCACAUC | 11453 | ccucAAAucAAGGcAcAucdTsdT | sense |
| 2405-2424 | 9454 | GAUGUGCCUUGAUUUGAGG | 11454 | GAUGUGCCUUGAUUUGAGGdTsdT | antis |
| 2483-2502 | 9455 | CUGCUGGAGUACACACCUA | 11455 | cuGcuGGAGuAcAcAccuAdTsdT | sense |
| 2483-2502 | 9456 | UAGGUGUGUACUCCAGCAG | 11456 | uAGGuGuGuACUCcAGcAGdTsdT | antis |
| 1629-1648 | 9457 | GCAAGGUAACCACAGUAGU | 11457 | GcAAGGuAAccAcAGuAGudTsdT | sense |
| 1629-1648 | 9458 | ACUACUGUGGUUACCUUGC | 11458 | ACuACUGUGGUuACCUUGCdTsdT | antis |
| 1972-1991 | 9459 | CAAGCAGACACUCCCUGUG | 11459 | cAAGcAGAcAcucccuGuGdTsdT | sense |
| 1972-1991 | 9460 | CACAGGGAGUGUCUGCUUG | 11460 | cAcAGGGAGUGUCUGCUUGdTsdT | antis |
| 1622-1641 | 9461 | GAUGGCAGCAAGGUAACCA | 11461 | GAuGGcAGcAAGGuAAccAdTsdT | sense |
| 1622-1641 | 9462 | UGGUUACCUUGCUGCCAUC | 11462 | UGGUuACCUUGCUGCcAUCdTsdT | antis |
| 1635-1654 | 9463 | UAACCACAGUAGUGGCAAC | 11463 | uAAccAcAGuAGuGGcAAcdTsdT | sense |
| 1635-1654 | 9464 | GUUGCCACUACUGUGGUUA | 11464 | GUUGCcACuACUGUGGUuAdTsdT | antis |
| 1790-1809 | 9465 | CAGGACAAGCGAUUUAAGA | 11465 | cAGGAcAAGcGAuuuAAGAdTsdT | sense |
| 1790-1809 | 9466 | UCUUAAAUCGCUUGUCCUG | 11466 | UCUuAAAUCGCUUGUCCUGdTsdT | antis |
| 1818-1837 | 9467 | UCCAGAUCAUGAGAAAGCU | 11467 | uccAGAucAuGAGAAAGcudTsdT | sense |
| 1818-1837 | 9468 | AGCUUUCUCAUGAUCUGGA | 11468 | AGCUUUCUcAUGAUCUGGAdTsdT | antis |
| 1854-1873 | 9469 | UCCGACUGCGGUAUUUCUU | 11469 | uccGAcuGcGGuAuuucuudTsdT | sense |
| 1854-1873 | 9470 | AAGAAAUACCGCAGUCGGA | 11470 | AAGAAAuACCGcAGUCGGAdTsdT | antis |
| 1942-1961 | 9471 | GUACAGAGUCGCCAGACAC | 11471 | GuAcAGAGucGccAGAcAcdTsdT | sense |
| 1942-1961 | 9472 | GUGUCUGGCGACUCUGUAC | 11472 | GUGUCUGGCGACUCUGuACdTsdT | antis |
| 1988-2007 | 9473 | GUGAUCUAUGUCAAGUUGU | 11473 | GuGAucuAuGucAAGuuGudTsdT | sense |
| 1988-2007 | 9474 | ACAACUUGACAUAGAUCAC | 11474 | AcAACUUGAcAuAGAUcACdTsdT | antis |
| 2055-2074 | 9475 | UCUGCCAUCGAGACAUUAA | 11475 | ucuGccAucGAGAcAuuAAdTsdT | sense |
| 2055-2074 | 9476 | UUAAUGUCUCGAUGGCAGA | 11476 | UuAAUGUCUCGAUGGcAGAdTsdT | antis |
| 2217-2236 | 9477 | CCACUGAUUACACGUCCAG | 11477 | ccAcuGAuuAcAcGuccAGdTsdT | sense |
| 2217-2236 | 9478 | CUGGACGUGUAAUCAGUGG | 11478 | CUGGACGUGuAAUcAGUGGdTsdT | antis |
| 2235-2254 | 9479 | GUAUAGAUGUAUGGUCUGC | 11479 | GuAuAGAuGuAuGGucuGcdTsdT | sense |
| 2235-2254 | 9480 | GCAGACCAUACAUCUAUAC | 11480 | GcAGACcAuAcAUCuAuACdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
| --- | --- | --- | --- | --- | --- |
| 2258-2277 | 9481 | UGUGUGUUGGCUGAAUUGU | 11481 | uGuGuGuuGGcuGAAuuGudTsdT | sense |
| 2258-2277 | 9482 | ACAAUUCAGCCAACACACA | 11482 | AcAAUUcAGCcAAcAcAcAdTsdT | antis |
| 2269-2288 | 9483 | UGAAUUGUUGCUAGGACAA | 11483 | uGAAuuGuuGcuAGGAcAAdTsdT | sense |
| 2269-2288 | 9484 | UUGUCCUAGCAACAAUUCA | 11484 | UUGUCCuAGcAAcAAUUcAdTsdT | antis |
| 2404-2423 | 9485 | CCCUCAAAUCAAGGCACAU | 11485 | cccucAAAucAAGGcAcAudTsdT | sense |
| 2404-2423 | 9486 | AUGUGCCUUGAUUUGAGGG | 11486 | AUGUGCCUUGAUUUGAGGGdTsdT | antis |
| 2423-2442 | 9487 | CCUUGGACAAAGGUCUUCC | 11487 | ccuuGGAcAAAGGucuuccdTsdT | sense |
| 2423-2442 | 9488 | GGAAGACCUUUGUCCAAGG | 11488 | GGAAGACCUUUGUCcAAGGdTsdT | antis |
| 2455-2474 | 9489 | ACCAGAGGCAAUUGCACUG | 11489 | AccAGAGGcAAuuGcAcuGdTsdT | sense |
| 2455-2474 | 9490 | CAGUGCAAUUGCCUCUGGU | 11490 | cAGUGcAAUUGCCUCUGGUdTsdT | antis |
| 1586-1605 | 9491 | UCAGCUUUUGGUAGCAUGA | 11491 | ucAGcuuuuGGuAGcAuGAdTsdT | sense |
| 1586-1605 | 9492 | UCAUGCUACCAAAAGCUGA | 11492 | UcAUGCuACcAAAAGCUGAdTsdT | antis |
| 1601-1620 | 9493 | AUGAAAGUUAGCAGAGAUA | 11493 | AuGAAAGuuAGcAGAGAuAdTsdT | sense |
| 1601-1620 | 9494 | UAUCUCUGCUAACUUUCAU | 11494 | uAUCUCUGCuAACUUUcAUdTsdT | antis |
| 1621-1640 | 9495 | AGAUGGCAGCAAGGUAACC | 11495 | AGAuGGcAGcAAGGuAAccdTsdT | sense |
| 1621-1640 | 9496 | GGUUACCUUGCUGCCAUCU | 11496 | GGUuACCUUGCUGCcAUCUdTsdT | antis |
| 1626-1645 | 9497 | GCAGCAAGGUAACCACAGU | 11497 | GcAGcAAGGuAAccAcAGudTsdT | sense |
| 1626-1645 | 9498 | ACUGUGGUUACCUUGCUGC | 11498 | ACUGUGGUuACCUUGCUGCdTsdT | antis |
| 1658-1677 | 9499 | GGCCAGGGUCCUGACAGGC | 11499 | GGccAGGGuccuGAcAGGcdTsdT | sense |
| 1658-1677 | 9500 | GCCUGUCAGGACCCUGGCC | 11500 | GCCUGUcAGGACCCUGGCCdTsdT | antis |
| 1683-1702 | 9501 | AAGUCAGUUAUACAGACAC | 11501 | AAGucAGuuAuAcAGAcAcdTsdT | sense |
| 1683-1702 | 9502 | GUGUCUGUAUAACUGACUU | 11502 | GUGUCUGuAuAACUGACUUdTsdT | antis |
| 1709-1728 | 9503 | AUUGGAAAUGGAUCAUUUG | 11503 | AuuGGAAAuGGAucAuuuGdTsdT | sense |
| 1709-1728 | 9504 | CAAAUGAUCCAUUUCCAAU | 11504 | cAAAUGAUCcAUUUCcAAUdTsdT | antis |
| 1710-1729 | 9505 | UUGGAAAUGGAUCAUUUGG | 11505 | uuGGAAAuGGAucAuuuGGdTsdT | sense |
| 1710-1729 | 9506 | CCAAAUGAUCCAUUUCCAA | 11506 | CcAAAUGAUCcAUUUCcAAdTsdT | antis |
| 1726-1745 | 9507 | UGGUGUGGUAUAUCAAGCC | 11507 | uGGuGuGGuAuAucAAGccdTsdT | sense |
| 1726-1745 | 9508 | GGCUUGAUAUACCACACCA | 11508 | GGCUUGAuAuACcAcACcAdTsdT | antis |
| 1740-1759 | 9509 | AAGCCAAACUUUGUGAUUC | 11509 | AAGccAAAcuuuGuGAuucdTsdT | sense |
| 1740-1759 | 9510 | GAAUCACAAAGUUUGGCUU | 11510 | GAAUcAcAAAGUUUGGCUUdTsdT | antis |
| 1754-1773 | 9511 | GAUUCUGGAGAACUGGUUG | 11511 | GAuucuGGAGAAcuGGuuGdTsdT | sense |
| 1754-1773 | 9512 | CAACCAGUUCUCCAGAAUC | 11512 | cAACcAGUUCUCcAGAAUCdTsdT | antis |
| 1755-1774 | 9513 | AUUCUGGAGAACUGGUUGC | 11513 | AuucuGGAGAAcuGGuuGcdTsdT | sense |
| 1755-1774 | 9514 | GCAACCAGUUCUCCAGAAU | 11514 | GcAACcAGUUCUCcAGAAUdTsdT | antis |
| 1757-1776 | 9515 | UCUGGAGAACUGGUUGCCA | 11515 | ucuGGAGAAcuGGuuGccAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1757-1776 | 9516 | UGGCAACCAGUUCUCCAGA | 11516 | UGGcAACcAGUUCUCcAGAdTsdT | antis |
| 1786-1805 | 9517 | UCUACAGGACAAGCGAUUU | 11517 | ucuAcAGGAcAAGcGAuuudTsdT | sense |
| 1786-1805 | 9518 | AAAUCGCUUGUCCUGUAGA | 11518 | AAAUCGCUUGUCCUGuAGAdTsdT | antis |
| 1834-1853 | 9519 | GCUAGACCACUGUAACAUA | 11519 | GcuAGAccAcuGuAAcAuAdTsdT | sense |
| 1834-1853 | 9520 | UAUGUUACAGUGGUCUAGC | 11520 | uAUGUuAcAGUGGUCuAGCdTsdT | antis |
| 1886-1905 | 9521 | GAGAAGAAAGAUGAGGUCU | 11521 | GAGAAGAAAGAuGAGGucudTsdT | sense |
| 1886-1905 | 9522 | AGACCUCAUCUUUCUUCUC | 11522 | AGACCUcAUCUUUCUUCUCdTsdT | antis |
| 1887-1906 | 9523 | AGAAGAAAGAUGAGGUCUA | 11523 | AGAAGAAAGAuGAGGucuAdTsdT | sense |
| 1887-1906 | 9524 | UAGACCUCAUCUUUCUUCU | 11524 | uAGACCUcAUCUUUCUUCUdTsdT | antis |
| 1892-1911 | 9525 | AAAGAUGAGGUCUACCUUA | 11525 | AAAGAuGAGGucuAccuuAdTsdT | sense |
| 1892-1911 | 9526 | UAAGGUAGACCUCAUCUUU | 11526 | uAAGGuAGACCUcAUCUUUdTsdT | antis |
| 1893-1912 | 9527 | AAGAUGAGGUCUACCUUAA | 11527 | AAGAuGAGGucuAccuuAAdTsdT | sense |
| 1893-1912 | 9528 | UUAAGGUAGACCUCAUCUU | 11528 | UuAAGGuAGACCUcAUCUUdTsdT | antis |
| 1925-1944 | 9529 | UAUGUUCCGGAGACAGUGU | 11529 | uAuGuuccGGAGAcAGuGudTsdT | sense |
| 1925-1944 | 9530 | ACACUGUCUCCGGAACAUA | 11530 | AcACUGUCUCCGGAAcAuAdTsdT | antis |
| 1937-1956 | 9531 | ACAGUGUACAGAGUCGCCA | 11531 | AcAGuGuAcAGAGucGccAdTsdT | sense |
| 1937-1956 | 9532 | UGGCGACUCUGUACACUGU | 11532 | UGGCGACUCUGuAcACUGUdTsdT | antis |
| 1978-1997 | 9533 | GACACUCCCUGUGAUCUAU | 11533 | GAcAcucccuGuGAucuAudTsdT | sense |
| 1978-1997 | 9534 | AUAGAUCACAGGGAGUGUC | 11534 | AuAGAUcAcAGGGAGUGUCdTsdT | antis |
| 1980-1999 | 9535 | CACUCCCUGUGAUCUAUGU | 11535 | cAcucccuGuGAucuAuGudTsdT | sense |
| 1980-1999 | 9536 | ACAUAGAUCACAGGGAGUG | 11536 | AcAuAGAUcAcAGGGAGUGdTsdT | antis |
| 2005-2024 | 9537 | GUAUAUGUAUCAGCUGUUC | 11537 | GuAuAuGuAucAGcuGuucdTsdT | sense |
| 2005-2024 | 9538 | GAACAGCUGAUACAUAUAC | 11538 | GAAcAGCUGAuAcAuAuACdTsdT | antis |
| 2074-2093 | 9539 | ACCACAGAACCUCUUGUUG | 11539 | AccAcAGAAccucuuGuuGdTsdT | sense |
| 2074-2093 | 9540 | CAACAAGAGGUUCUGUGGU | 11540 | cAAcAAGAGGUUCUGUGGUdTsdT | antis |
| 2081-2100 | 9541 | AACCUCUUGUUGGAUCCUG | 11541 | AAccucuuGuuGGAuccuGdTsdT | sense |
| 2081-2100 | 9542 | CAGGAUCCAACAAGAGGUU | 11542 | cAGGAUCcAAcAAGAGGUUdTsdT | antis |
| 2094-2113 | 9543 | AUCCUGAUACAGCUGUAUU | 11543 | AuccuGAuAcAGcuGuAuudTsdT | sense |
| 2094-2113 | 9544 | AAUACAGCUGUAUCAGGAU | 11544 | AAuAcAGCUGuAUcAGGAUdTsdT | antis |
| 2101-2120 | 9545 | UACAGCUGUAUUAAAACUC | 11545 | uAcAGcuGuAuuAAAAcucdTsdT | sense |
| 2101-2120 | 9546 | GAGUUUUAAUACAGCUGUA | 11546 | GAGUUUuAAuAcAGCUGuAdTsdT | antis |
| 2138-2157 | 9547 | AAGCAGCUGGUCCGAGGAG | 11547 | AAGcAGcuGGuccGAGGAGdTsdT | sense |
| 2138-2157 | 9548 | CUCCUCGGACCAGCUGCUU | 11548 | CUCCUCGGACcAGCUGCUUdTsdT | antis |
| 2161-2180 | 9549 | CAAUGUUUCAUAUAUCUGU | 11549 | cAAuGuuucAuAuAucuGudTsdT | sense |
| 2161-2180 | 9550 | ACAGAUAUAUGAAACAUUG | 11550 | AcAGAuAuAUGAAAcAUUGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2171-2190 | 9551 | UAUAUCUGUUCUCGGUACU | 11551 | uAuAucuGuucucGGuAcudTsdT | sense |
| 2171-2190 | 9552 | AGUACCGAGAACAGAUAUA | 11552 | AGuACCGAGAAcAGAuAuAdTsdT | antis |
| 2178-2197 | 9553 | GUUCUCGGUACUACAGGGC | 11553 | GuucucGGuAcuAcAGGGcdTsdT | sense |
| 2178-2197 | 9554 | GCCCUGUAGUACCGAGAAC | 11554 | GCCCUGuAGuACCGAGAACdTsdT | antis |
| 2193-2212 | 9555 | GGGCACCAGAGUUGAUCUU | 11555 | GGGcAccAGAGuuGAucuudTsdT | sense |
| 2193-2212 | 9556 | AAGAUCAACUCUGGUGCCC | 11556 | AAGAUcAACUCUGGUGCCCdTsdT | antis |
| 2197-2216 | 9557 | ACCAGAGUUGAUCUUUGGA | 11557 | AccAGAGuuGAucuuuGGAdTsdT | sense |
| 2197-2216 | 9558 | UCCAAAGAUCAACUCUGGU | 11558 | UCcAAAGAUcAACUCUGGUdTsdT | antis |
| 2209-2228 | 9559 | CUUUGGAGCCACUGAUUAC | 11559 | cuuuGGAGccAcuGAuuAcdTsdT | sense |
| 2209-2228 | 9560 | GUAAUCAGUGGCUCCAAAG | 11560 | GuAAUcAGUGGCUCcAAAGdTsdT | antis |
| 2215-2234 | 9561 | AGCCACUGAUUACACGUCC | 11561 | AGccAcuGAuuAcAcGuccdTsdT | sense |
| 2215-2234 | 9562 | GGACGUGUAAUCAGUGGCU | 11562 | GGACGUGuAAUcAGUGGCUdTsdT | antis |
| 2231-2250 | 9563 | UCCAGUAUAGAUGUAUGGU | 11563 | uccAGuAuAGAuGuAuGGudTsdT | sense |
| 2231-2250 | 9564 | ACCAUACAUCUAUACUGGA | 11564 | ACcAuAcAUCuAuACUGGAdTsdT | antis |
| 2308-2327 | 9565 | UGGUGUGGAUCAGUUGGUG | 11565 | uGGuGuGGAucAGuuGGuGdTsdT | sense |
| 2308-2327 | 9566 | CACCAACUGAUCCACACCA | 11566 | cACcAACUGAUCcAcACcAdTsdT | antis |
| 2334-2353 | 9567 | UAAAGGUCCUAGGAACACC | 11567 | uAAAGGuccuAGGAAcAccdTsdT | sense |
| 2334-2353 | 9568 | GGUGUUCCUAGGACCUUUA | 11568 | GGUGUUCCuAGGACCUUuAdTsdT | antis |
| 2336-2355 | 9569 | AAGGUCCUAGGAACACCAA | 11569 | AAGGuccuAGGAAcAccAAdTsdT | sense |
| 2336-2355 | 9570 | UUGGUGUUCCUAGGACCUU | 11570 | UUGGUGUUCCuAGGACCUUdTsdT | antis |
| 2337-2356 | 9571 | AGGUCCUAGGAACACCAAC | 11571 | AGGuccuAGGAAcAccAAcdTsdT | sense |
| 2337-2356 | 9572 | GUUGGUGUUCCUAGGACCU | 11572 | GUUGGUGUUCCuAGGACCUdTsdT | antis |
| 2343-2362 | 9573 | UAGGAACACCAACAAGGGA | 11573 | uAGGAAcAccAAcAAGGGAdTsdT | sense |
| 2343-2362 | 9574 | UCCCUUGUUGGUGUUCCUA | 11574 | UCCCUUGUUGGUGUUCCuAdTsdT | antis |
| 2352-2371 | 9575 | CAACAAGGGAGCAAAUUAG | 11575 | cAAcAAGGGAGcAAAuuAGdTsdT | sense |
| 2352-2371 | 9576 | CUAAUUUGCUCCCUUGUUG | 11576 | CuAAUUUGCUCCCUUGUUGdTsdT | antis |
| 2370-2389 | 9577 | GAGAAAUGAACCCAAAUUA | 11577 | GAGAAAuGAAcccAAAuuAdTsdT | sense |
| 2370-2389 | 9578 | UAAUUUGGGUUCAUUUCUC | 11578 | uAAUUUGGGUUcAUUUCUCdTsdT | antis |
| 2385-2404 | 9579 | AUUAUACAGAAUUCAAAUU | 11579 | AuuAuAcAGAAuucAAAuudTsdT | sense |
| 2385-2404 | 9580 | AAUUUGAAUUCUGUAUAAU | 11580 | AAUUUGAAUUCUGuAuAAUdTsdT | antis |
| 2392-2411 | 9581 | AGAAUUCAAAUUCCCUCAA | 11581 | AGAAuucAAAuucccucAAdTsdT | sense |
| 2392-2411 | 9582 | UUGAGGGAAUUUGAAUUCU | 11582 | UUGAGGGAAUUUGAAUUCUdTsdT | antis |
| 2393-2412 | 9583 | GAAUUCAAAUUCCCUCAAA | 11583 | GAAucAAAuucccucAAAdTsdT | sense |
| 2393-2412 | 9584 | UUUGAGGGAAUUUGAAUUC | 11584 | UUUGAGGGAAUUUGAAUUCdTsdT | antis |
| 2403-2422 | 9585 | UCCCUCAAAUCAAGGCACA | 11585 | ucccucAAAucAAGGcAcAdTsdT | sense |

TABLE 2-continued

Sequences of duplexes targeting Mouse GSK3-beta
Sequences of duplexes targeting mouse GSK3-beta. Target sequence location identifies target sequence in mouse GSK3-beta mRNA NM_019827.6. Sense strand is identical to target sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2403-2422 | 9586 | UGUGCCUUGAUUUGAGGGA | 11586 | UGUGCCUUGAUUUGAGGGAdTsdT | antis |
| 2421-2440 | 9587 | AUCCUUGGACAAAGGUCUU | 11587 | AuccuuGGAcAAAGGucuudTsdT | sense |
| 2421-2440 | 9588 | AAGACCUUUGUCCAAGGAU | 11588 | AAGACCUUUGUCcAAGGAUdTsdT | antis |
| 2424-2443 | 9589 | CUUGGACAAAGGUCUUCCG | 11589 | cuuGGAcAAAGGucuuccGdTsdT | sense |
| 2424-2443 | 9590 | CGGAAGACCUUUGUCCAAG | 11590 | CGGAAGACCUUUGUCcAAGdTsdT | antis |
| 2454-2473 | 9591 | CACCAGAGGCAAUUGCACU | 11591 | cAccAGAGGcAAuuGcAcudTsdT | sense |
| 2454-2473 | 9592 | AGUGCAAUUGCCUCUGGUG | 11592 | AGUGcAAUUGCCUCUGGUGdTsdT | antis |
| 2468-2487 | 9593 | GCACUGUGCAGCCGUCUGC | 11593 | GcAcuGuGcAGccGucuGcdTsdT | sense |
| 2468-2487 | 9594 | GCAGACGGCUGCACAGUGC | 11594 | GcAGACGGCUGcAcAGUGCdTsdT | antis |
| 2469-2488 | 9595 | CACUGUGCAGCCGUCUGCU | 11595 | cAcuGuGcAGccGucuGcudTsdT | sense |
| 2469-2488 | 9596 | AGCAGACGGCUGCACAGUG | 11596 | AGcAGACGGCUGcAcAGUGdTsdT | antis |
| 2516-2535 | 9597 | CCACUGGAAGCUUGUGCAC | 11597 | ccAcuGGAAGcuuGuGcAcdTsdT | sense |
| 2516-2535 | 9598 | GUGCACAAGCUUCCAGUGG | 11598 | GUGcAcAAGCUUCcAGUGGdTsdT | antis |
| 1559-1578 | 9599 | GAGAGCUGCAAGCCAGUGC | 11599 | GAGAGcuGcAAGccAGuGcdTsdT | sense |
| 1559-1578 | 9600 | GCACUGGCUUGCAGCUCUC | 11600 | GcACUGGCUUGcAGCUCUCdTsdT | antis |
| 1676-1695 | 9601 | CCACAGGAAGUCAGUUAUA | 11601 | ccAcAGGAAGucAGuuAuAdTsdT | sense |
| 1676-1695 | 9602 | UAUAACGACUUCCUGUGG | 11602 | uAuAACUGACUUCCUGUGGdTsdT | antis |
| 1896-1915 | 9603 | AUGAGGUCUACCUUAACCU | 11603 | AuGAGGucuAccuuAAccudTsdT | sense |
| 1896-1915 | 9604 | AGGUUAAGGUAGACCUCAU | 11604 | AGGUuAAGGuAGACCUcAUdTsdT | antis |
| 2262-2281 | 9605 | UGUUGGCUGAAUUGUUGCU | 11605 | uGuuGGcuGAAuuGuuGcudTsdT | sense |
| 2262-2281 | 9606 | AGCAACAAUUCAGCCAACA | 11606 | AGcAAcAAUUcAGCcAAcAdTsdT | antis |
| 2270-2289 | 9607 | GAAUUGUUGCUAGGACAAC | 11607 | GAAuuGuuGcuAGGAcAAcdTsdT | sense |
| 2270-2289 | 9608 | GUUGUCCUAGCAACAAUUC | 11608 | GUUGUCCuAGcAAcAAUUCdTsdT | antis |
| 1576-1595 | 9609 | GCAGCAGCCUUCAGCUUUU | 11609 | GcAGcAGccuucAGcuuuudTsdT | sense |
| 1576-1595 | 9610 | AAAAGCUGAAGGCUGCUGC | 11610 | AAAAGCUGAAGGCUGCUGCdTsdT | antis |
| 1577-1596 | 9611 | CAGCAGCCUUCAGCUUUUG | 11611 | cAGcAGccuucAGcuuuuGdTsdT | sense |
| 1577-1596 | 9612 | CAAAAGCUGAAGGCUGCUG | 11612 | cAAAAGCUGAAGGCUGCUGdTsdT | antis |
| 1623-1642 | 9613 | AUGGCAGCAAGGUAACCAC | 11613 | AuGGcAGcAAGGuAAccAcdTsdT | sense |
| 1623-1642 | 9614 | GUGGUUACCUUGCUGCCAU | 11614 | GUGGUuACCUUGCUGCcAUdTsdT | antis |
| 1645-1664 | 9615 | AGUGGCAACUCCUGGCCAG | 11615 | AGuGGcAAcuccuGGccAGdTsdT | sense |
| 1645-1664 | 9616 | CUGGCCAGGAGUUGCCACU | 11616 | CUGGCcAGGAGUUGCcACUdTsdT | antis |
| 1742-1761 | 9617 | GCCAAACUUUGUGAUUCUG | 11617 | GccAAAcuuuGuGAuucuGdTsdT | sense |
| 1742-1761 | 9618 | CAGAAUCACAAAGUUUGGC | 11618 | cAGAAUcAcAAAGUUUGGCdTsdT | antis |
| 1778-1797 | 9619 | AAGAAAGUUCUACAGGACA | 11619 | AAGAAAGuucuAcAGGAcAdTsdT | sense |
| 1778-1797 | 9620 | UGUCCUGUAGAACUUUCUU | 11620 | UGUCCUGuAGAACUUUCUUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1920-1939 | 9621 | UGGACUAUGUUCCGGAGAC | 11621 | uGGAcuAuGuuccGGAGAcdTsdT | sense |
| 1920-1939 | 9622 | GUCUCCGGAACAUAGUCCA | 11622 | GUCUCCGGAAcAuAGUCcAdTsdT | antis |
| 1973-1992 | 9623 | AAGCAGACACUCCCUGUGA | 11623 | AAGcAGAcAcucccuGuGAdTsdT | sense |
| 1973-1992 | 9624 | UCACAGGGAGUGUCUGCUU | 11624 | UcAcAGGGAGUGUCUGCUUdTsdT | antis |
| 1984-2003 | 9625 | CCCUGUGAUCUAUGUCAAG | 11625 | cccuGuGAucuAuGucAAGdTsdT | sense |
| 1984-2003 | 9626 | CUUGACAUAGAUCACAGGG | 11626 | CUUGAcAuAGAUcAcAGGGdTsdT | antis |
| 2085-2104 | 9627 | UCUUGUUGGAUCCUGAUAC | 11627 | ucuuGuuGGAuccuGAuAcdTsdT | sense |
| 2085-2104 | 9628 | GUAUCAGGAUCCAACAAGA | 11628 | GuAUcAGGAUCcAAcAAGAdTsdT | antis |
| 2090-2109 | 9629 | UUGGAUCCUGAUACAGCUG | 11629 | uuGGAuccuGAuAcAGcuGdTsdT | sense |
| 2090-2109 | 9630 | CAGCUGUAUCAGGAUCCAA | 11630 | cAGCUGuAUcAGGAUCcAAdTsdT | antis |
| 2170-2189 | 9631 | AUAUAUCUGUUCUCGGUAC | 11631 | AuAuAucuGuucucGGuAcdTsdT | sense |
| 2170-2189 | 9632 | GUACCGAGAACAGAUAUAU | 11632 | GuACCGAGAAcAGAuAuAUdTsdT | antis |
| 2200-2219 | 9633 | AGAGUUGAUCUUUGGAGCC | 11633 | AGAGuuGAucuuuGGAGccdTsdT | sense |
| 2200-2219 | 9634 | GGCUCCAAAGAUCAACUCU | 11634 | GGCUCcAAAGAUcAACUCUdTsdT | antis |
| 2253-2272 | 9635 | CAGGCUGUGUGUUGGCUGA | 11635 | cAGGcuGuGuGuuGGcuGAdTsdT | sense |
| 2253-2272 | 9636 | UCAGCCAACACACAGCCUG | 11636 | UcAGCcAAcAcAcAGCCUGdTsdT | antis |
| 2264-2283 | 9637 | UUGGCUGAAUUGUUGCUAG | 11637 | uuGGcuGAAuuGuuGcuAGdTsdT | sense |
| 2264-2283 | 9638 | CUAGCAACAAUUCAGCCAA | 11638 | CuAGcAAcAAUUcAGCcAAdTsdT | antis |
| 2285-2304 | 9639 | CAACCAAUAUUUCCUGGGG | 11639 | cAAccAAuAuuuccuGGGGdTsdT | sense |
| 2285-2304 | 9640 | CCCCAGGAAAUAUUGGUUG | 11640 | CCCcAGGAAAuAUUGGUUGdTsdT | antis |
| 2315-2334 | 9641 | GAUCAGUUGGUGGAAAUAA | 11641 | GAucAGuuGGuGGAAAuAAdTsdT | sense |
| 2315-2334 | 9642 | UUAUUUCCACCAACUGAUC | 11642 | UuAUUUCcACcAACUGAUCdTsdT | antis |
| 2452-2471 | 9643 | UCCACCAGAGGCAAUUGCA | 11643 | uccAccAGAGGcAAuuGcAdTsdT | sense |
| 2452-2471 | 9644 | UGCAAUUGCCUCUGGUGGA | 11644 | UGcAAUUGCCUCUGGUGGAdTsdT | antis |
| 2503-2522 | 9645 | CGCCCGGCUAACACCACUG | 11645 | cGcccGGcuAAcAccAcuGdTsdT | sense |
| 2503-2522 | 9646 | CAGUGGUGUUAGCCGGGCG | 11646 | cAGUGGUGUuAGCCGGGCGdTsdT | antis |
| 2504-2523 | 9647 | GCCCGGCUAACACCACUGG | 11647 | GcccGGcuAAcAccAcuGGdTsdT | sense |
| 2504-2523 | 9648 | CCAGUGGUGUUAGCCGGGC | 11648 | CcAGUGGUGUuAGCCGGGCdTsdT | antis |
| 1961-1980 | 9649 | UAUAGUCGAGCCAAGCAGA | 11649 | uAuAGucGAGccAAGcAGAdTsdT | sense |
| 1961-1980 | 9650 | UCUGCUUGGCUCGACUAUA | 11650 | UCUGCUUGGCUCGACuAuAdTsdT | antis |
| 1699-1718 | 9651 | CACGAAAGUGAUUGGAAAU | 11651 | cAcGAAAGuGAuuGGAAAudTsdT | sense |
| 1699-1718 | 9652 | AUUUCCAAUCACUUUCGUG | 11652 | AUUUCcAAUcACUUUCGUGdTsdT | antis |
| 1791-1810 | 9653 | AGGACAAGCGAUUUAAGAA | 11653 | AGGAcAAGcGAuuuAAGAAdTsdT | sense |
| 1791-1810 | 9654 | UUCUUAAAUCGCUUGUCCU | 11654 | UUCUuAAAUCGCUUGUCCUdTsdT | antis |
| 1534-1553 | 9655 | GCGACCGAGAACCACCUCC | 11655 | GcGAccGAGAAccAccuccdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1534-1553 | 9656 | GGAGGUGGUUCUCGGUCGC | 11656 | GGAGGUGGUUCUCGGUCGCdTsdT | antis |
| 1899-1918 | 9657 | AGGUCUACCUUAACCUGGU | 11657 | AGGucuAccuuAAccuGGudTsdT | sense |
| 1899-1918 | 9658 | ACCAGGUUAAGGUAGACCU | 11658 | ACcAGGUuAAGGuAGACCUdTsdT | antis |
| 1931-1950 | 9659 | CCGGAGACAGUGUACAGAG | 11659 | ccGGAGAcAGuGuAcAGAGdTsdT | sense |
| 1931-1950 | 9660 | CUCUGUACACUGUCUCCGG | 11660 | CUCUGuAcACUGUCUCCGGdTsdT | antis |
| 1964-1983 | 9661 | AGUCGAGCCAAGCAGACAC | 11661 | AGucGAGccAAGcAGAcAcdTsdT | sense |
| 1964-1983 | 9662 | GUGUCUGCUUGGCUCGACU | 11662 | GUGUCUGCUUGGCUCGACUdTsdT | antis |
| 2056-2075 | 9663 | CUGCCAUCGAGACAUUAAA | 11663 | cuGccAucGAGAcAuuAAAdTsdT | sense |
| 2056-2075 | 9664 | UUUAAUGUCUCGAUGGCAG | 11664 | UUuAAUGUCUCGAUGGcAGdTsdT | antis |
| 2155-2174 | 9665 | AGAGCCCAAUGUUUCAUAU | 11665 | AGAGcccAAuGuuucAuAudTsdT | sense |
| 2155-2174 | 9666 | AUAUGAAACAUUGGGCUCU | 11666 | AuAUGAAAcAUUGGGCUCUdTsdT | antis |
| 2182-2201 | 9667 | UCGGUACUACAGGGCACCA | 11667 | ucGGuAcuAcAGGGcAccAdTsdT | sense |
| 2182-2201 | 9668 | UGGUGCCCUGUAGUACCGA | 11668 | UGGUGCCCUGuAGuACCGAdTsdT | antis |
| 2329-2348 | 9669 | AAUAAUAAAGGUCCUAGGA | 11669 | AAuAAuAAAGGuccuAGGAdTsdT | sense |
| 2329-2348 | 9670 | UCCUAGGACCUUUAUUAUU | 11670 | UCCuAGGACCUUuAUuAUUdTsdT | antis |
| 2360-2379 | 9671 | GAGCAAAUUAGAGAAAUGA | 11671 | GAGcAAAuuAGAGAAAuGAdTsdT | sense |
| 2360-2379 | 9672 | UCAUUUCUCUAAUUUGCUC | 11672 | UcAUUUCUCuAAUUUGCUCdTsdT | antis |
| 2500-2519 | 9673 | UACCGCCCGGCUAACACCA | 11673 | uAccGcccGGcuAAcAccAdTsdT | sense |
| 2500-2519 | 9674 | UGGUGUUAGCCGGGCGGUA | 11674 | UGGUGUuAGCCGGGCGGuAdTsdT | antis |
| 1526-1545 | 9675 | AUGUCGGGGCGACCGAGAA | 11675 | AuGucGGGGcGAccGAGAAdTsdT | sense |
| 1526-1545 | 9676 | UUCUCGGUCGCCCCGACAU | 11676 | UUCUCGGUCGCCCCGAcAUdTsdT | antis |
| 1535-1554 | 9677 | CGACCGAGAACCACCUCCU | 11677 | cGAccGAGAAccAccuccudTsdT | sense |
| 1535-1554 | 9678 | AGGAGGUGGUUCUCGGUCG | 11678 | AGGAGGUGGUUCUCGGUCGdTsdT | antis |
| 1553-1572 | 9679 | UUUGCGGAGAGCUGCAAGC | 11679 | uuuGcGGAGAGcuGcAAGcdTsdT | sense |
| 1553-1572 | 9680 | GCUUGCAGCUCUCCGCAAA | 11680 | GCUUGcAGCUCUCCGcAAAdTsdT | antis |
| 1628-1647 | 9681 | AGCAAGGUAACCACAGUAG | 11681 | AGcAAGGuAAccAcAGuAGdTsdT | sense |
| 1628-1647 | 9682 | CUACUGUGGUUACCUUGCU | 11682 | CuACUGUGGUuACCUUGCUdTsdT | antis |
| 1633-1652 | 9683 | GGUAACCACAGUAGUGGCA | 11683 | GGuAAccAcAGuAGuGGcAdTsdT | sense |
| 1633-1652 | 9684 | UGCCACUACUGUGGUUACC | 11684 | UGCcACuACUGUGGUuACCdTsdT | antis |
| 1682-1701 | 9685 | GAAGUCAGUUAUACAGACA | 11685 | GAAGucAGuuAuAcAGAcAdTsdT | sense |
| 1682-1701 | 9686 | UGUCUGUAUAACUGACUUC | 11686 | UGUCUGuAuAACUGACUUCdTsdT | antis |
| 1684-1703 | 9687 | AGUCAGUUAUACAGACACG | 11687 | AGucAGuuAuAcAGAcAcGdTsdT | sense |
| 1684-1703 | 9688 | CGUGUCUGUAUAACUGACU | 11688 | CGUGUCUGuAuAACUGACUdTsdT | antis |
| 1698-1717 | 9689 | ACACGAAAGUGAUUGGAAA | 11689 | AcAcGAAAGuGAuuGGAAAdTsdT | sense |
| 1698-1717 | 9690 | UUUCCAAUCACUUUCGUGU | 11690 | UUUCcAAUcACUUUCGUGUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1700-1719 | 9691 | ACGAAAGUGAUUGGAAAUG | 11691 | AcGAAAGuGAuuGGAAAuGdTsdT | sense |
| 1700-1719 | 9692 | CAUUUCCAAUCACUUUCGU | 11692 | cAUUUCcAAUcACUUUCGUdTsdT | antis |
| 1703-1722 | 9693 | AAAGUGAUUGGAAAUGGAU | 11693 | AAAGuGAuuGGAAAuGGAudTsdT | sense |
| 1703-1722 | 9694 | AUCCAUUUCCAAUCACUUU | 11694 | AUCcAUUUCcAAUcACUUUdTsdT | antis |
| 1735-1754 | 9695 | AUAUCAAGCCAAACUUUGU | 11695 | AuAucAAGccAAAcuuuGudTsdT | sense |
| 1735-1754 | 9696 | ACAAAGUUUGGCUUGAUAU | 11696 | AcAAAGUUUGGCUUGAuAUdTsdT | antis |
| 1741-1760 | 9697 | AGCCAAACUUUGUGAUUCU | 11697 | AGccAAAcuuuGuGAuucudTsdT | sense |
| 1741-1760 | 9698 | AGAAUCACAAAGUUUGGCU | 11698 | AGAAUcAcAAAGUUUGGCUdTsdT | antis |
| 1773-1792 | 9699 | CCAUCAAGAAAGUUCUACA | 11699 | ccAucAAGAAAGuucuAcAdTsdT | sense |
| 1773-1792 | 9700 | UGUAGAACUUUCUUGAUGG | 11700 | UGuAGAACUUUCUUGAUGGdTsdT | antis |
| 1774-1793 | 9701 | CAUCAAGAAAGUUCUACAG | 11701 | cAucAAGAAAGuucuAcAGdTsdT | sense |
| 1774-1793 | 9702 | CUGUAGAACUUUCUUGAUG | 11702 | CUGuAGAACUUUCUUGAUGdTsdT | antis |
| 1784-1803 | 9703 | GUUCUACAGGACAAGCGAU | 11703 | GuucuAcAGGAcAAGcGAudTsdT | sense |
| 1784-1803 | 9704 | AUCGCUUGUCCUGUAGAAC | 11704 | AUCGCUUGUCCUGuAGAACdTsdT | antis |
| 1823-1842 | 9705 | AUCAUGAGAAAGCUAGACC | 11705 | AucAuGAGAAAGcuAGAccdTsdT | sense |
| 1823-1842 | 9706 | GGUCUAGCUUUCUCAUGAU | 11706 | GGUCuAGCUUUCUcAUGAUdTsdT | antis |
| 1868-1887 | 9707 | UUCUUCUACUCGAGUGGUG | 11707 | uucuucuAcucGAGuGGuGdTsdT | sense |
| 1868-1887 | 9708 | CACCACUCGAGUAGAAGAA | 11708 | cAccACUCGAGuAGAAGAAdTsdT | antis |
| 1876-1895 | 9709 | CUCGAGUGGUGAGAAGAAA | 11709 | cucGAGuGGuGAGAAGAAAdTsdT | sense |
| 1876-1895 | 9710 | UUUCUUCUCACCACUCGAG | 11710 | UUUCUUCUcACcACUCGAGdTsdT | antis |
| 1907-1926 | 9711 | CUUAACCUGGUGCUGGACU | 11711 | cuuAAccuGGuGcuGGAcudTsdT | sense |
| 1907-1926 | 9712 | AGUCCAGCACCAGGUUAAG | 11712 | AGUCcAGcACcAGGUuAAGdTsdT | antis |
| 1910-1929 | 9713 | AACCUGGUGCUGGACUAUG | 11713 | AAccuGGuGcuGGAcuAuGdTsdT | sense |
| 1910-1929 | 9714 | CAUAGUCCAGCACCAGGUU | 11714 | cAuAGUCcAGcACcAGGUUdTsdT | antis |
| 1930-1949 | 9715 | UCCGGAGACAGUGUACAGA | 11715 | uccGGAGAcAGuGuAcAGAdTsdT | sense |
| 1930-1949 | 9716 | UCUGUACACUGUCUCCGGA | 11716 | UCUGuAcACUGUCUCCGGAdTsdT | antis |
| 1939-1958 | 9717 | AGUGUACAGAGUCGCCAGA | 11717 | AGuGuAcAGAGucGccAGAdTsdT | sense |
| 1939-1958 | 9718 | UCUGGCGACUCUGUACACU | 11718 | UCUGGCGACUCUGuAcACUdTsdT | antis |
| 1940-1959 | 9719 | GUGUACAGAGUCGCCAGAC | 11719 | GuGuAcAGAGucGccAGAcdTsdT | sense |
| 1940-1959 | 9720 | GUCUGGCGACUCUGUACAC | 11720 | GUCUGGCGACUCUGuAcACdTsdT | antis |
| 1943-1962 | 9721 | UACAGAGUCGCCAGACACU | 11721 | uAcAGAGucGccAGAcAcudTsdT | sense |
| 1943-1962 | 9722 | AGUGUCUGGCGACUCUGUA | 11722 | AGUGUCUGGCGACUCUGuAdTsdT | antis |
| 1946-1965 | 9723 | AGAGUCGCCAGACACUAUA | 11723 | AGAGucGccAGAcAcuAuAdTsdT | sense |
| 1946-1965 | 9724 | UAUAGUGUCUGGCGACUCU | 11724 | uAuAGUGUCUGGCGACUCUdTsdT | antis |
| 1948-1967 | 9725 | AGUCGCCAGACACUAUAGU | 11725 | AGucGccAGAcAcuAuAGudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1948-1967 | 9726 | ACUAUAGUGUCUGGCGACU | 11726 | ACuAuAGUGUCUGGCGACUdTsdT | antis |
| 1963-1982 | 9727 | UAGUCGAGCCAAGCAGACA | 11727 | uAGucGAGccAAGcAGAcAdTsdT | sense |
| 1963-1982 | 9728 | UGUCUGCUUGGCUCGACUA | 11728 | UGUCUGCUUGGCUCGACUAdTsdT | antis |
| 1987-2006 | 9729 | UGUGAUCUAUGUCAAGUUG | 11729 | uGuGAucuAuGucAAGuuGdTsdT | sense |
| 1987-2006 | 9730 | CAACUUGACAUAGAUCACA | 11730 | cAACUUGAcAuAGAUcAcAdTsdT | antis |
| 1991-2010 | 9731 | AUCUAUGUCAAGUUGUAUA | 11731 | AucuAuGucAAGuuGuAuAdTsdT | sense |
| 1991-2010 | 9732 | UAUACAACUUGACAUAGAU | 11732 | uAuAcAACUUGAcAuAGAUdTsdT | antis |
| 1992-2011 | 9733 | UCUAUGUCAAGUUGUAUAU | 11733 | ucuAuGucAAGuuGuAuAudTsdT | sense |
| 1992-2011 | 9734 | AUAUACAACUUGACAUAGA | 11734 | AuAuAcAACUUGAcAuAGAdTsdT | antis |
| 2000-2019 | 9735 | AAGUUGUAUAUGUAUCAGC | 11735 | AAGuuGuAuAuGuAucAGcdTsdT | sense |
| 2000-2019 | 9736 | GCUGAUACAUAUACAACUU | 11736 | GCUGAuAcAuAuAcAACUUdTsdT | antis |
| 2001-2020 | 9737 | AGUUGUAUAUGUAUCAGCU | 11737 | AGuuGuAuAuGuAucAGcudTsdT | sense |
| 2001-2020 | 9738 | AGCUGAUACAUAUACAACU | 11738 | AGCUGAuAcAuAuAcAACUdTsdT | antis |
| 2004-2023 | 9739 | UGUAUAUGUAUCAGCUGUU | 11739 | uGuAuAuGuAucAGcuGuudTsdT | sense |
| 2004-2023 | 9740 | AACAGCUGAUACAUAUACA | 11740 | AAcAGCUGAuAcAuAuAcAdTsdT | antis |
| 2007-2026 | 9741 | AUAUGUAUCAGCUGUUCAG | 11741 | AuAuGuAucAGcuGuucAGdTsdT | sense |
| 2007-2026 | 9742 | CUGAACAGCUGAUACAUAU | 11742 | CUGAAcAGCUGAuAcAuAUdTsdT | antis |
| 2048-2067 | 9743 | UUUGGAAUCUGCCAUCGAG | 11743 | uuuGGAAucuGccAucGAGdTsdT | sense |
| 2048-2067 | 9744 | CUCGAUGGCAGAUUCCAAA | 11744 | CUCGAUGGcAGAUUCcAAAdTsdT | antis |
| 2100-2119 | 9745 | AUACAGCUGUAUUAAAACU | 11745 | AuAcAGcuGuAuuAAAAcudTsdT | sense |
| 2100-2119 | 9746 | AGUUUUAAUACAGCUGUAU | 11746 | AGUUUuAAuAcAGCUGuAUdTsdT | antis |
| 2107-2126 | 9747 | UGUAUUAAAACUCUGUGAC | 11747 | uGuAuuAAAAcucuGuGAcdTsdT | sense |
| 2107-2126 | 9748 | GUCACAGAGUUUUAAUACA | 11748 | GUcAcAGAGUUUuAAuAcAdTsdT | antis |
| 2151-2170 | 9749 | GAGGAGAGCCCAAUGUUUC | 11749 | GAGGAGAGcccAAuGuuucdTsdT | sense |
| 2151-2170 | 9750 | GAAACAUUGGGCUCUCCUC | 11750 | GAAAcAUUGGGCUCUCCUCdTsdT | antis |
| 2158-2177 | 9751 | GCCCAAUGUUUCAUAUAUC | 11751 | GcccAAuGuuucAuAuAucdTsdT | sense |
| 2158-2177 | 9752 | GAUAUAUGAAACAUUGGGC | 11752 | GAuAuAUGAAAcAUUGGGCdTsdT | antis |
| 2166-2185 | 9753 | UUUCAUAUAUCUGUUCUCG | 11753 | uuucAuAuAucuGuucucGdTsdT | sense |
| 2166-2185 | 9754 | CGAGAACAGAUAUAUGAAA | 11754 | CGAGAAcAGAuAuAUGAAAdTsdT | antis |
| 2172-2191 | 9755 | AUAUCUGUUCUCGGUACUA | 11755 | AuAucuGuucucGGuAcuAdTsdT | sense |
| 2172-2191 | 9756 | UAGUACCGAGAACAGAUAU | 11756 | uAGuACCGAGAAcAGAuAUdTsdT | antis |
| 2183-2202 | 9757 | CGGUACUACAGGGCACCAG | 11757 | cGGuAcuAcAGGGcAccAGdTsdT | sense |
| 2183-2202 | 9758 | CUGGUGCCCUGUAGUACCG | 11758 | CUGGUGCCCUGuAGuACCGdTsdT | antis |
| 2232-2251 | 9759 | CCAGUAUAGAUGUAUGGUC | 11759 | ccAGuAuAGAuGuAuGGucdTsdT | sense |
| 2232-2251 | 9760 | GACCAUACAUCUAUACUGG | 11760 | GACcAuAcAUCuAuACUGGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2273-2292 | 9761 | UUGUUGCUAGGACAACCAA | 11761 | uuGuuGcuAGGAcAAccAAdTsdT | sense |
| 2273-2292 | 9762 | UUGGUUGUCCUAGCAACAA | 11762 | UUGGUUGUCCuAGcAAcAAdTsdT | antis |
| 2274-2293 | 9763 | UGUUGCUAGGACAACCAAU | 11763 | uGuuGcuAGGAcAAccAAudTsdT | sense |
| 2274-2293 | 9764 | AUUGGUUGUCCUAGCAACA | 11764 | AUUGGUUGUCCuAGcAAcAdTsdT | antis |
| 2318-2337 | 9765 | CAGUUGGUGGAAAUAAUAA | 11765 | cAGuuGGuGGAAAuAAuAAdTsdT | sense |
| 2318-2337 | 9766 | UUAUUAUUUCCACCAACUG | 11766 | UuAUuAUUUCcACcAACUGdTsdT | antis |
| 2361-2380 | 9767 | AGCAAAUUAGAGAAAUGAA | 11767 | AGcAAAuuAGAGAAAuGAAdTsdT | sense |
| 2361-2380 | 9768 | UUCAUUUCUCUAAUUUGCU | 11768 | UUcAUUUCUCuAAUUUGCUdTsdT | antis |
| 2380-2399 | 9769 | CCCAAAUUAUACAGAAUUC | 11769 | cccAAAuuAuAcAGAAuucdTsdT | sense |
| 2380-2399 | 9770 | GAAUUCUGUAUAAUUUGGG | 11770 | GAAUUCUGuAuAAUUUGGGdTsdT | antis |
| 2400-2419 | 9771 | AAUUCCCUCAAAUCAAGGC | 11771 | AAuucccucAAAucAAGGcdTsdT | sense |
| 2400-2419 | 9772 | GCCUUGAUUUGAGGGAAUU | 11772 | GCCUUGAUUUGAGGGAAUUdTsdT | antis |
| 2409-2428 | 9773 | AAAUCAAGGCACAUCCUUG | 11773 | AAAucAAGGcAcAuccuuGdTsdT | sense |
| 2409-2428 | 9774 | CAAGGAUGUGCCUUGAUUU | 11774 | cAAGGAUGUGCCUUGAUUUdTsdT | antis |
| 2445-2464 | 9775 | CCCGAACUCCACCAGAGGC | 11775 | cccGAAcuccAccAGAGGcdTsdT | sense |
| 2445-2464 | 9776 | GCCUCUGGUGGAGUUCGGG | 11776 | GCCUCUGGUGGAGUUCGGGdTsdT | antis |
| 2479-2498 | 9777 | CCGUCUGCUGGAGUACACA | 11777 | ccGucuGcuGGAGuAcAcAdTsdT | sense |
| 2479-2498 | 9778 | UGUGUACUCCAGCAGACGG | 11778 | UGUGuACUCcAGcAGACGGdTsdT | antis |
| 2489-2508 | 9779 | GAGUACACACCUACCGCCC | 11779 | GAGuAcAcAccuAccGcccdTsdT | sense |
| 2489-2508 | 9780 | GGGCGGUAGGUGUGUACUC | 11780 | GGGCGGuAGGUGUGuACUCdTsdT | antis |
| 1819-1838 | 9781 | CCAGAUCAUGAGAAAGCUA | 11781 | ccAGAucAuGAGAAAGcuAdTsdT | sense |
| 1819-1838 | 9782 | UAGCUUUCUCAUGAUCUGG | 11782 | uAGCUUUCUcAUGAUCUGGdTsdT | antis |
| 2030-2049 | 9783 | CUAGCCUAUAUCCAUUCCU | 11783 | cuAGccuAuAuccAuuccudTsdT | sense |
| 2030-2049 | 9784 | AGGAAUGGAUAUAGGCUAG | 11784 | AGGAAUGGAuAuAGGCuAGdTsdT | antis |
| 2154-2173 | 9785 | GAGAGCCCAAUGUUUCAUA | 11785 | GAGAGcccAAuGuuucAuAdTsdT | sense |
| 2154-2173 | 9786 | UAUGAAACAUUGGGCUCUC | 11786 | uAUGAAcAUUGGGCUCUCdTsdT | antis |
| 2184-2203 | 9787 | GGUACUACAGGGCACCAGA | 11787 | GGuAcuAcAGGGcAccAGAdTsdT | sense |
| 2184-2203 | 9788 | UCUGGUGCCCUGUAGUACC | 11788 | UCUGGUGCCCUGuAGuACCdTsdT | antis |
| 2190-2209 | 9789 | ACAGGGCACCAGAGUUGAU | 11789 | AcAGGGcAccAGAGuuGAudTsdT | sense |
| 2190-2209 | 9790 | AUCAACUCUGGUGCCCUGU | 11790 | AUcAACUCUGGUGCCCUGUdTsdT | antis |
| 2314-2333 | 9791 | GGAUCAGUUGGUGGAAAUA | 11791 | GGAucAGuuGGuGGAAAuAdTsdT | sense |
| 2314-2333 | 9792 | UAUUUCCACCAACUGAUCC | 11792 | uAUUUCcACcAACUGAUCCdTsdT | antis |
| 2428-2447 | 9793 | GACAAAGGUCUUCCGGCCC | 11793 | GAcAAAGGucuuccGGcccdTsdT | sense |
| 2428-2447 | 9794 | GGGCCGGAAGACCUUUGUC | 11794 | GGGCCGGAAGACCUUUGUCdTsdT | antis |
| 1913-1932 | 9795 | CUGGUGCUGGACUAUGUUC | 11795 | cuGGuGcuGGAcuAuGuucdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1913-1932 | 9796 | GAACAUAGUCCAGCACCAG | 11796 | GAAcAuAGUCcAGcACcAGdTsdT | antis |
| 1530-1549 | 9797 | CGGGGCGACCGAGAACCAC | 11797 | cGGGGcGAccGAGAAccAcdTsdT | sense |
| 1530-1549 | 9798 | GUGGUUCUCGGUCGCCCCG | 11798 | GUGGUUCUCGGUCGCCCCGdTsdT | antis |
| 1549-1568 | 9799 | CUCCUUUGCGGAGAGCUGC | 11799 | cuccuuuGcGGAGAGcuGcdTsdT | sense |
| 1549-1568 | 9800 | GCAGCUCUCCGCAAAGGAG | 11800 | GcAGCUCUCCGcAAAGGAGdTsdT | antis |
| 1550-1569 | 9801 | UCCUUUGCGGAGAGCUGCA | 11801 | uccuuuGcGGAGAGcuGcAdTsdT | sense |
| 1550-1569 | 9802 | UGCAGCUCUCCGCAAAGGA | 11802 | UGcAGCUCUCCGcAAAGGAdTsdT | antis |
| 1610-1629 | 9803 | AGCAGAGAUAAAGAUGGCA | 11803 | AGcAGAGAuAAAGAuGGcAdTsdT | sense |
| 1610-1629 | 9804 | UGCCAUCUUUAUCUCUGCU | 11804 | UGCcAUCUUuAUCUCUGCUdTsdT | antis |
| 1642-1661 | 9805 | AGUAGUGGCAACUCCUGGC | 11805 | AGuAGuGGcAAcuccuGGcdTsdT | sense |
| 1642-1661 | 9806 | GCCAGGAGUUGCCACUACU | 11806 | GCcAGGAGUUGCcACuACUdTsdT | antis |
| 1643-1662 | 9807 | GUAGUGGCAACUCCUGGCC | 11807 | GuAGuGGcAAcuccuGGccdTsdT | sense |
| 1643-1662 | 9808 | GGCCAGGAGUUGCCACUAC | 11808 | GGCcAGGAGUUGCcACuACdTsdT | antis |
| 1696-1715 | 9809 | AGACACGAAAGUGAUUGGA | 11809 | AGAcAcGAAAGuGAuuGGAdTsdT | sense |
| 1696-1715 | 9810 | UCCAAUCACUUUCGUGUCU | 11810 | UCcAAUcACUUUCGUGUCUdTsdT | antis |
| 1704-1723 | 9811 | AAGUGAUUGGAAAUGGAUC | 11811 | AAGuGAuuGGAAAuGGAucdTsdT | sense |
| 1704-1723 | 9812 | GAUCCAUUUCCAAUCACUU | 11812 | GAUCcAUUUCcAAUcACUUdTsdT | antis |
| 1719-1738 | 9813 | GAUCAUUUGGUGUGGUAUA | 11813 | GAucAuuuGGuGuGGuAuAdTsdT | sense |
| 1719-1738 | 9814 | UAUACCACACCAAAUGAUC | 11814 | uAuACcAcACcAAAUGAUCdTsdT | antis |
| 1728-1747 | 9815 | GUGUGGUAUAUCAAGCCAA | 11815 | GuGuGGuAuAucAAGccAAdTsdT | sense |
| 1728-1747 | 9816 | UUGGCUUGAUAUACCACAC | 11816 | UUGGCUUGAuAuACcAcACdTsdT | antis |
| 1731-1750 | 9817 | UGGUAUAUCAAGCCAAACU | 11817 | uGGuAuAucAAGccAAAcudTsdT | sense |
| 1731-1750 | 9818 | AGUUUGGCUUGAUAUACCA | 11818 | AGUUUGGCUUGAuAuACcAdTsdT | antis |
| 1732-1751 | 9819 | GGUAUAUCAAGCCAAACUU | 11819 | GGuAuAucAAGccAAAcuudTsdT | sense |
| 1732-1751 | 9820 | AAGUUUGGCUUGAUAUACC | 11820 | AAGUUUGGCUUGAuAuACCdTsdT | antis |
| 1733-1752 | 9821 | GUAUAUCAAGCCAAACUUU | 11821 | GuAuAucAAGccAAAcuuudTsdT | sense |
| 1733-1752 | 9822 | AAAGUUUGGCUUGAUAUAC | 11822 | AAAGUUUGGCUUGAuAuACdTsdT | antis |
| 1768-1787 | 9823 | GGUUGCCAUCAAGAAAGUU | 11823 | GGuuGccAucAAGAAAGuudTsdT | sense |
| 1768-1787 | 9824 | AACUUUCUUGAUGGCAACC | 11824 | AACUUUCUUGAUGGcAACCdTsdT | antis |
| 1800-1819 | 9825 | GAUUUAAGAACCGAGAGCU | 11825 | GAuuuAAGAAccGAGAGcudTsdT | sense |
| 1800-1819 | 9826 | AGCUCUCGGUUCUUAAAUC | 11826 | AGCUCUCGGUUCUuAAAUCdTsdT | antis |
| 1802-1821 | 9827 | UUUAAGAACCGAGAGCUCC | 11827 | uuuAAGAAccGAGAGcuccdTsdT | sense |
| 1802-1821 | 9828 | GGAGCUCUCGGUUCUUAAA | 11828 | GGAGCUCUCGGUUCUuAAAdTsdT | antis |
| 1821-1840 | 9829 | AGAUCAUGAGAAAGCUAGA | 11829 | AGAucAuGAGAAAGcuAGAdTsdT | sense |
| 1821-1840 | 9830 | UCUAGCUUUCUCAUGAUCU | 11830 | UCuAGCUUUCUcAUGAUCUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1830-1849 | 9831 | GAAAGCUAGACCACUGUAA | 11831 | GAAAGcuAGAccAcuGuAAdTsdT | sense |
| 1830-1849 | 9832 | UUACAGUGGUCUAGCUUUC | 11832 | UuAcAGUGGUCuAGCUUUCdTsdT | antis |
| 1831-1850 | 9833 | AAAGCUAGACCACUGUAAC | 11833 | AAAGcuAGAccAcuGuAAcdTsdT | sense |
| 1831-1850 | 9834 | GUUACAGUGGUCUAGCUUU | 11834 | GUuAcAGUGGUCuAGCUUUdTsdT | antis |
| 1856-1875 | 9835 | CGACUGCGGUAUUUCUUCU | 11835 | cGAcuGcGGuAuuucuucudTsdT | sense |
| 1856-1875 | 9836 | AGAAGAAAUACCGCAGUCG | 11836 | AGAAGAAAuACCGcAGUCGdTsdT | antis |
| 1857-1876 | 9837 | GACUGCGGUAUUUCUUCUA | 11837 | GAcuGcGGuAuuucuucuAdTsdT | sense |
| 1857-1876 | 9838 | UAGAAGAAAUACCGCAGUC | 11838 | uAGAAGAAAuACCGcAGUCdTsdT | antis |
| 1875-1894 | 9839 | ACUCGAGUGGUGAGAAGAA | 11839 | AcucGAGuGGuGAGAAGAAdTsdT | sense |
| 1875-1894 | 9840 | UUCUUCUCACCACUCGAGU | 11840 | UUCUUCUcACcACUCGAGUdTsdT | antis |
| 1877-1896 | 9841 | UCGAGUGGUGAGAAGAAAG | 11841 | ucGAGuGGuGAGAAGAAAGdTsdT | sense |
| 1877-1896 | 9842 | CUUUCUUCUCACCACUCGA | 11842 | CUUUCUUCUcACcACUCGAdTsdT | antis |
| 1897-1916 | 9843 | UGAGGUCUACCUUAACCUG | 11843 | uGAGGucuAccuuAAccuGdTsdT | sense |
| 1897-1916 | 9844 | CAGGUUAAGGUAGACCUCA | 11844 | cAGGUuAAGGuAGACCUcAdTsdT | antis |
| 1908-1927 | 9845 | UUAACCUGGUGCUGGACUA | 11845 | uuAAccuGGuGcuGGAcuAdTsdT | sense |
| 1908-1927 | 9846 | UAGUCCAGCACCAGGUUAA | 11846 | uAGUCcAGcACcAGGUuAAdTsdT | antis |
| 1923-1942 | 9847 | ACUAUGUUCCGGAGACAGU | 11847 | AcuAuGuuccGGAGAcAGudTsdT | sense |
| 1923-1942 | 9848 | ACUGUCUCCGGAACAUAGU | 11848 | ACUGUCUCCGGAAcAuAGUdTsdT | antis |
| 1928-1947 | 9849 | GUUCCGGAGACAGUGUACA | 11849 | GuuccGGAGAcAGuGuAcAdTsdT | sense |
| 1928-1947 | 9850 | UGUACACUGUCUCCGGAAC | 11850 | UGuAcACUGUCUCCGGAACdTsdT | antis |
| 1934-1953 | 9851 | GAGACAGUGUACAGAGUCG | 11851 | GAGAcAGuGuAcAGAGucGdTsdT | sense |
| 1934-1953 | 9852 | CGACUCUGUACACUGUCUC | 11852 | CGACUCUGuAcACUGUCUCdTsdT | antis |
| 1951-1970 | 9853 | CGCCAGACACUAUAGUCGA | 11853 | cGccAGAcAcuAuAGucGAdTsdT | sense |
| 1951-1970 | 9854 | UCGACUAUAGUGUCUGGCG | 11854 | UCGACuAuAGUGUCUGGCGdTsdT | antis |
| 1981-2000 | 9855 | ACUCCCUGUGAUCUAUGUC | 11855 | AcucccuGuGAucuAuGucdTsdT | sense |
| 1981-2000 | 9856 | GACAUAGAUCACAGGGAGU | 11856 | GAcAuAGAUcAcAGGGAGUdTsdT | antis |
| 1983-2002 | 9857 | UCCCUGUGAUCUAUGUCAA | 11857 | ucccuGuGAucuAuGucAAdTsdT | sense |
| 1983-2002 | 9858 | UUGACAUAGAUCACAGGGA | 11858 | UUGAcAuAGAUcAcAGGGAdTsdT | antis |
| 1994-2013 | 9859 | UAUGUCAAGUUGUAUAUGU | 11859 | uAuGucAAGuuGuAuAuGudTsdT | sense |
| 1994-2013 | 9860 | ACAUAUACAACUUGACAUA | 11860 | AcAuAuAcAACUUGAcAuAdTsdT | antis |
| 2003-2022 | 9861 | UUGUAUAUGUAUCAGCUGU | 11861 | uuGuAuAuGuAucAGcuGudTsdT | sense |
| 2003-2022 | 9862 | ACAGCUGAUACAUAUACAA | 11862 | AcAGCUGAuAcAuAuAcAAdTsdT | antis |
| 2067-2086 | 9863 | ACAUUAAACCACAGAACCU | 11863 | AcAuuAAAccAcAGAAccudTsdT | sense |
| 2067-2086 | 9864 | AGGUUCUGUGGUUUAAUGU | 11864 | AGGUUCUGUGGUUuAAUGUdTsdT | antis |
| 2077-2096 | 9865 | ACAGAACCUCUUGUUGGAU | 11865 | AcAGAAccucuuGuuGGAudTsdT | sense |

TABLE 2-continued

Sequences of duplexes targeting Mouse GSK3-beta
Sequences of duplexes targeting mouse GSK3-beta. Target sequence location identifies target sequence in mouse GSK3-beta mRNA NM_019827.6. Sense strand is identical to target sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2077-2096 | 9866 | AUCCAACAAGAGGUUCUGU | 11866 | AUCcAAcAAGAGGUUCUGUdTsdT | antis |
| 2079-2098 | 9867 | AGAACCUCUUGUUGGAUCC | 11867 | AGAAccucuuGuuGGAuccdTsdT | sense |
| 2079-2098 | 9868 | GGAUCCAACAAGAGGUUCU | 11868 | GGAUCcAAcAAGAGGUUCUdTsdT | antis |
| 2087-2106 | 9869 | UUGUUGGAUCCUGAUACAG | 11869 | uuGuuGGAuccuGAuAcAGdTsdT | sense |
| 2087-2106 | 9870 | CUGUAUCAGGAUCCAACAA | 11870 | CUGuAUcAGGAUCcAAcAAdTsdT | antis |
| 2093-2112 | 9871 | GAUCCUGAUACAGCUGUAU | 11871 | GAuccuGAuAcAGcuGuAudTsdT | sense |
| 2093-2112 | 9872 | AUACAGCUGUAUCAGGAUC | 11872 | AuAcAGCUGuAUcAGGAUCdTsdT | antis |
| 2099-2118 | 9873 | GAUACAGCUGUAUUAAAAC | 11873 | GAuAcAGcuGuAuuAAAAcdTsdT | sense |
| 2099-2118 | 9874 | GUUUUAAUACAGCUGUAUC | 11874 | GUUUuAAuAcAGCUGuAUCdTsdT | antis |
| 2135-2154 | 9875 | GCAAAGCAGCUGGUCCGAG | 11875 | GcAAAGcAGcuGGuccGAGdTsdT | sense |
| 2135-2154 | 9876 | CUCGGACCAGCUGCUUUGC | 11876 | CUCGGACcAGCUGCUUUGCdTsdT | antis |
| 2150-2169 | 9877 | CGAGGAGAGCCCAAUGUUU | 11877 | cGAGGAGAGcccAAuGuuudTsdT | sense |
| 2150-2169 | 9878 | AAACAUUGGGCUCUCCUCG | 11878 | AAAcAUUGGGCUCUCCUCGdTsdT | antis |
| 2157-2176 | 9879 | AGCCCAAUGUUUCAUAUAU | 11879 | AGcccAAuGuuucAuAuAudTsdT | sense |
| 2157-2176 | 9880 | AUAUAUGAAACAUUGGGCU | 11880 | AuAuAUGAAAcAUUGGGCUdTsdT | antis |
| 2198-2217 | 9881 | CCAGAGUUGAUCUUUGGAG | 11881 | ccAGAGuuGAucuuuGGAGdTsdT | sense |
| 2198-2217 | 9882 | CUCCAAAGAUCAACUCUGG | 11882 | CUCcAAAGAUcAACUCUGGdTsdT | antis |
| 2199-2218 | 9883 | CAGAGUUGAUCUUUGGAGC | 11883 | cAGAGuuGAucuuuGGAGCdTsdT | sense |
| 2199-2218 | 9884 | GCUCCAAAGAUCAACUCUG | 11884 | GCUCcAAAGAUcAACUCUGdTsdT | antis |
| 2216-2235 | 9885 | GCCACUGAUUACACGUCCA | 11885 | GccAcuGAuuAcAcGuccAdTsdT | sense |
| 2216-2235 | 9886 | UGGACGUGUAAUCAGUGGC | 11886 | UGGACGUGuAAUcAGUGGCdTsdT | antis |
| 2237-2256 | 9887 | AUAGAUGUAUGGUCUGCAG | 11887 | AuAGAuGuAuGGucuGcAGdTsdT | sense |
| 2237-2256 | 9888 | CUGCAGACCAUACAUCUAU | 11888 | CUGcAGACcAuAcAUCuAUdTsdT | antis |
| 2243-2262 | 9889 | GUAUGGUCUGCAGGCUGUG | 11889 | GuAuGGucuGcAGGcuGuGdTsdT | sense |
| 2243-2262 | 9890 | CACAGCCUGCAGACCAUAC | 11890 | cAcAGCCUGcAGACcAuACdTsdT | antis |
| 2272-2291 | 9891 | AUUGUUGCUAGGACAACCA | 11891 | AuuGuuGcuAGGAcAAccAdTsdT | sense |
| 2272-2291 | 9892 | UGGUUGUCCUAGCAACAAU | 11892 | UGGUUGUCCuAGcAAcAAUdTsdT | antis |
| 2283-2302 | 9893 | GACAACCAAUAUUUCCUGG | 11893 | GAcAAccAAuAuuuccuGGdTsdT | sense |
| 2283-2302 | 9894 | CCAGGAAAUAUUGGUUGUC | 11894 | CcAGGAAAuAUUGGUUGUCdTsdT | antis |
| 2291-2310 | 9895 | AUAUUUCCUGGGGACAGUG | 11895 | AuAuuuccuGGGGAcAGuGdTsdT | sense |
| 2291-2310 | 9896 | CACUGUCCCCAGGAAAUAU | 11896 | cACUGUCCcAGGAAAuAUdTsdT | antis |
| 2311-2330 | 9897 | UGUGGAUCAGUUGGUGGAA | 11897 | uGuGGAucAGuuGGuGGAAdTsdT | sense |
| 2311-2330 | 9898 | UUCCACCAACUGAUCCACA | 11898 | UUCcAccAACUGAUCcAcAdTsdT | antis |
| 2353-2372 | 9899 | AACAAGGGAGCAAAUUAGA | 11899 | AAcAAGGGAGcAAAuuAGAdTsdT | sense |
| 2353-2372 | 9900 | UCUAAUUGCUCCCUUGUU | 11900 | UCuAAUUGCUCCCUUGUUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2359-2378 | 9901 | GGAGCAAAUUAGAGAAAUG | 11901 | GGAGcAAAuuAGAGAAAuGdTsdT | sense |
| 2359-2378 | 9902 | CAUUUCUCUAAUUUGCUCC | 11902 | cAUUUCUCUuAAUUUGCUCCdTsdT | antis |
| 2379-2398 | 9903 | ACCCAAAUUAUACAGAAUU | 11903 | AcccAAAuuAuAcAGAAuudTsdT | sense |
| 2379-2398 | 9904 | AAUUCUGUAUAAUUUGGGU | 11904 | AAUUCUGuAuAAUUUGGGUdTsdT | antis |
| 2408-2427 | 9905 | CAAAUCAAGGCACAUCCUU | 11905 | cAAAucAAGGcAcAuccuudTsdT | sense |
| 2408-2427 | 9906 | AAGGAUGUGCCUUGAUUUG | 11906 | AAGGAUGUGCCUUGAUUUGdTsdT | antis |
| 2412-2431 | 9907 | UCAAGGCACAUCCUUGGAC | 11907 | ucAAGGcAcAuccuuGGAcdTsdT | sense |
| 2412-2431 | 9908 | GUCCAAGGAUGUGCCUUGA | 11908 | GUCcAAGGAUGUGCCUUGAdTsdT | antis |
| 2438-2457 | 9909 | UUCCGGCCCCGAACUCCAC | 11909 | uuccGGccccGAAcuccAcdTsdT | sense |
| 2438-2457 | 9910 | GUGGAGUUCGGGGCCGGAA | 11910 | GUGGAGUUCGGGGCCGGAAdTsdT | antis |
| 2476-2495 | 9911 | CAGCCGUCUGCUGGAGUAC | 11911 | cAGccGucuGcuGGAGuAcdTsdT | sense |
| 2476-2495 | 9912 | GUACUCCAGCAGACGGCUG | 11912 | GuACUCcAGcAGACGGCUGdTsdT | antis |
| 2477-2496 | 9913 | AGCCGUCUGCUGGAGUACA | 11913 | AGccGucuGcuGGAGuAcAdTsdT | sense |
| 2477-2496 | 9914 | UGUACUCCAGCAGACGGCU | 11914 | UGuACUCcAGcAGACGGCUdTsdT | antis |
| 2478-2497 | 9915 | GCCGUCUGCUGGAGUACAC | 11915 | GccGucuGcuGGAGuAcAcdTsdT | sense |
| 2478-2497 | 9916 | GUGUACUCCAGCAGACGGC | 11916 | GUGuACUCcAGcAGACGGCdTsdT | antis |
| 2484-2503 | 9917 | UGCUGGAGUACACACCUAC | 11917 | uGcuGGAGuAcAcAccuAcdTsdT | sense |
| 2484-2503 | 9918 | GUAGGUGUGUACUCCAGCA | 11918 | GuAGGUGUGuACUCcAGcAdTsdT | antis |
| 1527-1546 | 9919 | UGUCGGGGCGACCGAGAAC | 11919 | uGucGGGGcGAccGAGAAcdTsdT | sense |
| 1527-1546 | 9920 | GUUCUCGGUCGCCCCGACA | 11920 | GUUCUCGGUCGCCCCGAcAdTsdT | antis |
| 1531-1550 | 9921 | GGGGCGACCGAGAACCACC | 11921 | GGGGcGAccGAGAAccAccdTsdT | sense |
| 1531-1550 | 9922 | GGUGGUUCUCGGUCGCCCC | 11922 | GGUGGUUCUCGGUCGCCCCdTsdT | antis |
| 1536-1555 | 9923 | GACCGAGAACCACCUCCUU | 11923 | GAccGAGAAccAccuccuudTsdT | sense |
| 1536-1555 | 9924 | AAGGAGGUGGUUCUCGGUC | 11924 | AAGGAGGUGGUUCUCGGUCdTsdT | antis |
| 1542-1561 | 9925 | GAACCACCUCCUUUGCGGA | 11925 | GAAccAccuccuuuGcGGAdTsdT | sense |
| 1542-1561 | 9926 | UCCGCAAAGGAGGUGGUUC | 11926 | UCCGcAAAGGAGGUGGUUCdTsdT | antis |
| 1552-1571 | 9927 | CUUUGCGGAGAGCUGCAAG | 11927 | cuuuGcGGAGAGcuGcAAGdTsdT | sense |
| 1552-1571 | 9928 | CUUGCAGCUCUCCGCAAAG | 11928 | CUUGcAGCUCUCCGcAAAGdTsdT | antis |
| 1556-1575 | 9929 | GCGGAGAGCUGCAAGCCAG | 11929 | GcGGAGAGcuGcAAGccAGdTsdT | sense |
| 1556-1575 | 9930 | CUGGCUUGCAGCUCUCCGC | 11930 | CUGGCUUGcAGCUCUCCGCdTsdT | antis |
| 1564-1583 | 9931 | CUGCAAGCCAGUGCAGCAG | 11931 | cuGcAAGccAGuGcAGcAGdTsdT | sense |
| 1564-1583 | 9932 | CUGCUGCACUGGCUUGCAG | 11932 | CUGCUGcACUGGCUUGcAGdTsdT | antis |
| 1572-1591 | 9933 | CAGUGCAGCAGCCUUCAGC | 11933 | cAGuGcAGcAGccuucAGcdTsdT | sense |
| 1572-1591 | 9934 | GCUGAAGGCUGCUGCACUG | 11934 | GCUGAAGGCUGCUGcACUGdTsdT | antis |
| 1578-1597 | 9935 | AGCAGCCUUCAGCUUUUGG | 11935 | AGcAGccuucAGcuuuuGGdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1578-1597 | 9936 | CCAAAAGCUGAAGGCUGCU | 11936 | CcAAAAGCUGAAGGCUGCUdTsdT | antis |
| 1579-1598 | 9937 | GCAGCCUUCAGCUUUUGGU | 11937 | GcAGccuucAGcuuuuGGudTsdT | sense |
| 1579-1598 | 9938 | ACCAAAAGCUGAAGGCUGC | 11938 | ACcAAAAGCUGAAGGCUGCdTsdT | antis |
| 1581-1600 | 9939 | AGCCUUCAGCUUUUGGUAG | 11939 | AGccuucAGcuuuuGGuAGdTsdT | sense |
| 1581-1600 | 9940 | CUACCAAAAGCUGAAGGCU | 11940 | CuACcAAAAGCUGAAGGCUdTsdT | antis |
| 1582-1601 | 9941 | GCCUUCAGCUUUUGGUAGC | 11941 | GccuucAGcuuuuGGuAGcdTsdT | sense |
| 1582-1601 | 9942 | GCUACCAAAAGCUGAAGGC | 11942 | GCuACcAAAAGCUGAAGGCdTsdT | antis |
| 1585-1604 | 9943 | UUCAGCUUUUGGUAGCAUG | 11943 | uucAGcuuuuGGuAGcAuGdTsdT | sense |
| 1585-1604 | 9944 | CAUGCUACCAAAAGCUGAA | 11944 | cAUGCuACcAAAAGCUGAAdTsdT | antis |
| 1587-1606 | 9945 | CAGCUUUUGGUAGCAUGAA | 11945 | cAGcuuuuGGuAGcAuGAAdTsdT | sense |
| 1587-1606 | 9946 | UUCAUGCUACCAAAAGCUG | 11946 | UUcAUGCuACcAAAAGCUGdTsdT | antis |
| 1588-1607 | 9947 | AGCUUUUGGUAGCAUGAAA | 11947 | AGcuuuuGGuAGcAuGAAAdTsdT | sense |
| 1588-1607 | 9948 | UUUCAUGCUACCAAAAGCU | 11948 | UUUcAUGCuACcAAAAGCUdTsdT | antis |
| 1598-1617 | 9949 | AGCAUGAAAGUUAGCAGAG | 11949 | AGcAuGAAAGuuAGcAGAGdTsdT | sense |
| 1598-1617 | 9950 | CUCUGCUAACUUUCAUGCU | 11950 | CUCUGCuAACUUUcAUGCUdTsdT | antis |
| 1602-1621 | 9951 | UGAAAGUUAGCAGAGAUAA | 11951 | uGAAAGuuAGcAGAGAuAAdTsdT | sense |
| 1602-1621 | 9952 | UUAUCUCUGCUAACUUUCA | 11952 | UuAUCUCUGCuAACUUUcAdTsdT | antis |
| 1618-1637 | 9953 | UAAAGAUGGCAGCAAGGUA | 11953 | uAAAGAuGGcAGcAAGGuAdTsdT | sense |
| 1618-1637 | 9954 | UACCUUGCUGCCAUCUUUA | 11954 | uACCUUGCUGCcAUCUUUAdTsdT | antis |
| 1619-1638 | 9955 | AAAGAUGGCAGCAAGGUAA | 11955 | AAAGAuGGcAGcAAGGuAAdTsdT | sense |
| 1619-1638 | 9956 | UUACCUUGCUGCCAUCUUU | 11956 | UuACCUUGCUGCcAUCUUUdTsdT | antis |
| 1625-1644 | 9957 | GGCAGCAAGGUAACCACAG | 11957 | GGcAGcAAGGuAAccAcAGdTsdT | sense |
| 1625-1644 | 9958 | CUGUGGUUACCUUGCUGCC | 11958 | CUGUGGUuACCUUGCUGCCdTsdT | antis |
| 1627-1646 | 9959 | CAGCAAGGUAACCACAGUA | 11959 | cAGcAAGGuAAccAcAGuAdTsdT | sense |
| 1627-1646 | 9960 | UACUGUGGUUACCUUGCUG | 11960 | uACUGUGGUuACCUUGCUGdTsdT | antis |
| 1636-1655 | 9961 | AACCACAGUAGUGGCAACU | 11961 | AAccAcAGuAGuGGcAAcudTsdT | sense |
| 1636-1655 | 9962 | AGUUGCCACUACUGUGGUU | 11962 | AGUUGCcAcuACUGUGGUUdTsdT | antis |
| 1637-1656 | 9963 | ACCACAGUAGUGGCAACUC | 11963 | AccAcAGuAGuGGcAAcucdTsdT | sense |
| 1637-1656 | 9964 | GAGUUGCCACUACUGUGGU | 11964 | GAGUUGCcACuACUGUGGUdTsdT | antis |
| 1646-1665 | 9965 | GUGGCAACUCCUGGCCAGG | 11965 | GuGGcAAcuccuGGccAGGdTsdT | sense |
| 1646-1665 | 9966 | CCUGGCCAGGAGUUGCCAC | 11966 | CCUGGCcAGGAGUUGCcACdTsdT | antis |
| 1648-1667 | 9967 | GGCAACUCCUGGCCAGGGU | 11967 | GGcAAcuccuGGccAGGGudTsdT | sense |
| 1648-1667 | 9968 | ACCCUGGCCAGGAGUUGCC | 11968 | ACCCUGGCcAGGAGUUGCCdTsdT | antis |
| 1649-1668 | 9969 | GCAACUCCUGGCCAGGGUC | 11969 | GcAAcuccuGGccAGGGucdTsdT | sense |
| 1649-1668 | 9970 | GACCCUGGCCAGGAGUUGC | 11970 | GACCCUGGCcAGGAGUUGCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1651-1670 | 9971 | AACUCCUGGCCAGGGUCCU | 11971 | AAcuccuGGccAGGGuccudTsdT | sense |
| 1651-1670 | 9972 | AGGACCCUGGCCAGGAGUU | 11972 | AGGACCCUGGCcAGGAGUUdTsdT | antis |
| 1666-1685 | 9973 | UCCUGACAGGCCACAGGAA | 11973 | uccuGAcAGGccAcAGGAAdTsdT | sense |
| 1666-1685 | 9974 | UUCCUGUGGCCUGUCAGGA | 11974 | UUCCUGUGGCCUGUcAGGAdTsdT | antis |
| 1667-1686 | 9975 | CCUGACAGGCCACAGGAAG | 11975 | ccuGAcAGGccAcAGGAAGdTsdT | sense |
| 1667-1686 | 9976 | CUUCCUGUGGCCUGUCAGG | 11976 | CUUCCUGUGGCCUGUcAGGdTsdT | antis |
| 1669-1688 | 9977 | UGACAGGCCACAGGAAGUC | 11977 | uGAcAGGccAcAGGAAGucdTsdT | sense |
| 1669-1688 | 9978 | GACUUCCUGUGGCCUGUCA | 11978 | GACUUCCUGUGGCCUGUcAdTsdT | antis |
| 1670-1689 | 9979 | GACAGGCCACAGGAAGUCA | 11979 | GAcAGGccAcAGGAAGucAdTsdT | sense |
| 1670-1689 | 9980 | UGACUUCCUGUGGCCUGUC | 11980 | UGACUUCCUGUGGCCUGUCdTsdT | antis |
| 1685-1704 | 9981 | GUCAGUUAUACAGACACGA | 11981 | GucAGuuAuAcAGAcAcGAdTsdT | sense |
| 1685-1704 | 9982 | UCGUGUCUGUAUAACUGAC | 11982 | UCGUGUCUGuAuAACUGACdTsdT | antis |
| 1687-1706 | 9983 | CAGUUAUACAGACACGAAA | 11983 | cAGuuAuAcAGAcAcGAAAdTsdT | sense |
| 1687-1706 | 9984 | UUUCGUGUCUGUAUAACUG | 11984 | UUUCGUGUCUGuAuAACUGdTsdT | antis |
| 1689-1708 | 9985 | GUUAUACAGACACGAAAGU | 11985 | GuuAuAcAGAcAcGAAAGudTsdT | sense |
| 1689-1708 | 9986 | ACUUUCGUGUCUGUAUAAC | 11986 | ACUUUCGUGUCUGuAuAACdTsdT | antis |
| 1691-1710 | 9987 | UAUACAGACACGAAAGUGA | 11987 | uAuAcAGAcAcGAAAGuGAdTsdT | sense |
| 1691-1710 | 9988 | UCACUUUCGUGUCUGUAUA | 11988 | UcACUUUCGUGUCUGuAuAdTsdT | antis |
| 1693-1712 | 9989 | UACAGACACGAAAGUGAUU | 11989 | uAcAGAcAcGAAAGuGAuudTsdT | sense |
| 1693-1712 | 9990 | AAUCACUUUCGUGUCUGUA | 11990 | AAUcACUUUCGUGUCUGuAdTsdT | antis |
| 1701-1720 | 9991 | CGAAAGUGAUUGGAAAUGG | 11991 | cGAAAGuGAuuGGAAAuGGdTsdT | sense |
| 1701-1720 | 9992 | CCAUUUCCAAUCACUUUCG | 11992 | CcAUUUCcAAUcACUUUCGdTsdT | antis |
| 1707-1726 | 9993 | UGAUUGGAAAUGGAUCAUU | 11993 | uGAuuGGAAAuGGAucAuudTsdT | sense |
| 1707-1726 | 9994 | AAUGAUCCAUUUCCAAUCA | 11994 | AAUGAUCcAUUUCcAAUcAdTsdT | antis |
| 1717-1736 | 9995 | UGGAUCAUUUGGUGUGGUA | 11995 | uGGAucAuuuGGuGuGGuAdTsdT | sense |
| 1717-1736 | 9996 | UACCACACCAAAUGAUCCA | 11996 | uACcAcACcAAAUGAUCcAdTsdT | antis |
| 1721-1740 | 9997 | UCAUUUGGUGUGGUAUAUC | 11997 | ucAuuuGGuGuGGuAuAucdTsdT | sense |
| 1721-1740 | 9998 | GAUAUACCACACCAAAUGA | 11998 | GAuAuACcAcACcAAAUGAdTsdT | antis |
| 1729-1748 | 9999 | UGUGGUAUAUCAAGCCAAA | 11999 | uGuGGuAuAucAAGccAAAdTsdT | sense |
| 1729-1748 | 10000 | UUUGGCUUGAUAUACCACA | 12000 | UUUGGCUUGAuAuACcAcAdTsdT | antis |
| 1734-1753 | 10001 | UAUAUCAAGCCAAACUUUG | 12001 | uAuAucAAGccAAAcuuuGdTsdT | sense |
| 1734-1753 | 10002 | CAAAGUUUGGCUUGAUAUA | 12002 | cAAAGUUUGGCUUGAuAuAdTsdT | antis |
| 1736-1755 | 10003 | UAUCAAGCCAAACUUUGUG | 12003 | uAucAAGccAAAcuuuGuGdTsdT | sense |
| 1736-1755 | 10004 | CACAAAGUUUGGCUUGAUA | 12004 | cAcAAAGUUUGGCUUGAuAdTsdT | antis |
| 1737-1756 | 10005 | AUCAAGCCAAACUUUGUGA | 12005 | AucAAGccAAAcuuuGuGAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1737-1756 | 10006 | UCACAAAGUUUGGCUUGAU | 12006 | UcAcAAAGUUUGGCUUGAUdTsdT | antis |
| 1749-1768 | 10007 | UUUGUGAUUCUGGAGAACU | 12007 | uuuGuGAuucuGGAGAAcudTsdT | sense |
| 1749-1768 | 10008 | AGUUCUCCAGAAUCACAAA | 12008 | AGUUCUCcAGAAUcAcAAAdTsdT | antis |
| 1759-1778 | 10009 | UGGAGAACUGGUUGCCAUC | 12009 | uGGAGAAcuGGuuGccAucdTsdT | sense |
| 1759-1778 | 10010 | GAUGGCAACCAGUUCUCCA | 12010 | GAUGGcAACcAGUUCUCcAdTsdT | antis |
| 1760-1779 | 10011 | GGAGAACUGGUUGCCAUCA | 12011 | GGAGAAcuGGuuGccAucAdTsdT | sense |
| 1760-1779 | 10012 | UGAUGGCAACCAGUUCUCC | 12012 | UGAUGGcAACcAGUUCUCCdTsdT | antis |
| 1767-1786 | 10013 | UGGUUGCCAUCAAGAAAGU | 12013 | uGGuuGccAucAAGAAAGudTsdT | sense |
| 1767-1786 | 10014 | ACUUUCUUGAUGGCAACCA | 12014 | ACUUUCUUGAUGGcAACcAdTsdT | antis |
| 1769-1788 | 10015 | GUUGCCAUCAAGAAAGUUC | 12015 | GuuGccAucAAGAAAGuucdTsdT | sense |
| 1769-1788 | 10016 | GAACUUUCUUGAUGGCAAC | 12016 | GAACUUUCUUGAUGGcAACdTsdT | antis |
| 1770-1789 | 10017 | UUGCCAUCAAGAAAGUUCU | 12017 | uuGccAucAAGAAAGuucudTsdT | sense |
| 1770-1789 | 10018 | AGAACUUUCUUGAUGGCAA | 12018 | AGAACUUUCUUGAUGGcAAdTsdT | antis |
| 1775-1794 | 10019 | AUCAAGAAAGUUCUACAGG | 12019 | AucAAGAAAGuucuAcAGGdTsdT | sense |
| 1775-1794 | 10020 | CCUGUAGAACUUUCUUGAU | 12020 | CCUGuAGAACUUUCUUGAUdTsdT | antis |
| 1783-1802 | 10021 | AGUUCUACAGGACAAGCGA | 12021 | AGuucuAcAGGAcAAGcGAdTsdT | sense |
| 1783-1802 | 10022 | UCGCUUGUCCUGUAGAACU | 12022 | UCGCUUGUCCUGuAGAACUdTsdT | antis |
| 1787-1806 | 10023 | CUACAGGACAAGCGAUUUA | 12023 | cuAcAGGAcAAGcGAuuuAdTsdT | sense |
| 1787-1806 | 10024 | UAAAUCGCUUGUCCUGUAG | 12024 | uAAAUCGCUUGUCCUGuAGdTsdT | antis |
| 1806-1825 | 10025 | AGAACCGAGAGCUCCAGAU | 12025 | AGAAccGAGAGcuccAGAudTsdT | sense |
| 1806-1825 | 10026 | AUCUGGAGCUCUCGGUUCU | 12026 | AUCUGGAGCUCUCGGUUCUdTsdT | antis |
| 1810-1829 | 10027 | CCGAGAGCUCCAGAUCAUG | 12027 | ccGAGAGcuccAGAucAuGdTsdT | sense |
| 1810-1829 | 10028 | CAUGAUCUGGAGCUCUCGG | 12028 | cAUGAUCUGGAGCUCUCGGdTsdT | antis |
| 1815-1834 | 10029 | AGCUCCAGAUCAUGAGAAA | 12029 | AGcuccAGAucAuGAGAAAdTsdT | sense |
| 1815-1834 | 10030 | UUUCUCAUGAUCUGGAGCU | 12030 | UUUCUcAUGAUCUGGAGCUdTsdT | antis |
| 1816-1835 | 10031 | GCUCCAGAUCAUGAGAAAG | 12031 | GcuccAGAucAuGAGAAAGdTsdT | sense |
| 1816-1835 | 10032 | CUUUCUCAUGAUCUGGAGC | 12032 | CUUUCUcAUGAUCUGGAGCdTsdT | antis |
| 1817-1836 | 10033 | CUCCAGAUCAUGAGAAAGC | 12033 | cuccAGAucAuGAGAAAGcdTsdT | sense |
| 1817-1836 | 10034 | GCUUUCUCAUGAUCUGGAG | 12034 | GCUUUCUcAUGAUCUGGAGdTsdT | antis |
| 1820-1839 | 10035 | CAGAUCAUGAGAAAGCUAG | 12035 | cAGAucAuGAGAAAGcuAGdTsdT | sense |
| 1820-1839 | 10036 | CUAGCUUUCUCAUGAUCUG | 12036 | CuAGCUUUCUcAUGAUCUGdTsdT | antis |
| 1824-1843 | 10037 | UCAUGAGAAAGCUAGACCA | 12037 | ucAuGAGAAAGcuAGAccAdTsdT | sense |
| 1824-1843 | 10038 | UGGUCUAGCUUUCUCAUGA | 12038 | UGGUCuAGCUUUCUcAUGAdTsdT | antis |
| 1825-1844 | 10039 | CAUGAGAAAGCUAGACCAC | 12039 | cAuGAGAAAGcuAGAccAcdTsdT | sense |
| 1825-1844 | 10040 | GUGGUCUAGCUUUCUCAUG | 12040 | GUGGUCuAGCUUUCUcAUGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1826-1845 | 10041 | AUGAGAAAGCUAGACCACU | 12041 | AuGAGAAAGcuAGAccAcudTsdT | sense |
| 1826-1845 | 10042 | AGUGGUCUAGCUUUCUCAU | 12042 | AGUGGUCuAGCUUUCUcAUdTsdT | antis |
| 1858-1877 | 10043 | ACUGCGGUAUUUCUUCUAC | 12043 | AcuGcGGuAuuucuucuAcdTsdT | sense |
| 1858-1877 | 10044 | GUAGAAGAAAUACCGCAGU | 12044 | GuAGAAGAAAuACCGcAGUdTsdT | antis |
| 1866-1885 | 10045 | AUUUCUUCUACUCGAGUGG | 12045 | AuuucuucuAcucGAGuGGdTsdT | sense |
| 1866-1885 | 10046 | CCACUCGAGUAGAAGAAAU | 12046 | CcACUCGAGuAGAAGAAAUdTsdT | antis |
| 1869-1888 | 10047 | UCUUCUACUCGAGUGGUGA | 12047 | ucuucuAcucGAGuGGuGAdTsdT | sense |
| 1869-1888 | 10048 | UCACCACUCGAGUAGAAGA | 12048 | UcACcACUCGAGuAGAAGAdTsdT | antis |
| 1878-1897 | 10049 | CGAGUGGUGAGAAGAAAGA | 12049 | cGAGuGGuGAGAAGAAAGAdTsdT | sense |
| 1878-1897 | 10050 | UCUUUCUUCUCACCACUCG | 12050 | UCUUUCUUCUcACcACUCGdTsdT | antis |
| 1890-1909 | 10051 | AGAAAGAUGAGGUCUACCU | 12051 | AGAAAGAuGAGGucuAccudTsdT | sense |
| 1890-1909 | 10052 | AGGUAGACCUCAUCUUUCU | 12052 | AGGuAGACCUcAUCUUUCUdTsdT | antis |
| 1891-1910 | 10053 | GAAAGAUGAGGUCUACCUU | 12053 | GAAAGAuGAGGucuAccuudTsdT | sense |
| 1891-1910 | 10054 | AAGGUAGACCUCAUCUUUC | 12054 | AAGGuAGACCUcAUCUUUCdTsdT | antis |
| 1898-1917 | 10055 | GAGGUCUACCUUAACCUGG | 12055 | GAGGucuAccuuAAccuGGdTsdT | sense |
| 1898-1917 | 10056 | CCAGGUUAAGGUAGACCUC | 12056 | CcAGGUuAAGGuAGACCUCdTsdT | antis |
| 1903-1922 | 10057 | CUACCUUAACCUGGUGCUG | 12057 | cuAccuuAAccuGGuGcuGdTsdT | sense |
| 1903-1922 | 10058 | CAGCACCAGGUUAAGGUAG | 12058 | cAGcACcAGGUuAAGGuAGdTsdT | antis |
| 1911-1930 | 10059 | ACCUGGUGCUGGACUAUGU | 12059 | AccuGGuGcuGGAcuAuGudTsdT | sense |
| 1911-1930 | 10060 | ACAUAGUCCAGCACCAGGU | 12060 | AcAuAGUCcAGcACcAGGUdTsdT | antis |
| 1912-1931 | 10061 | CCUGGUGCUGGACUAUGUU | 12061 | ccuGGuGcuGGAcuAuGuudTsdT | sense |
| 1912-1931 | 10062 | AACAUAGUCCAGCACCAGG | 12062 | AAcAuAGUCcAGcACcAGGdTsdT | antis |
| 1915-1934 | 10063 | GGUGCUGGACUAUGUUCCG | 12063 | GGuGcuGGAcuAuGuuccGdTsdT | sense |
| 1915-1934 | 10064 | CGGAACAUAGUCCAGCACC | 12064 | CGGAAcAuAGUCcAGcACCdTsdT | antis |
| 1929-1948 | 10065 | UUCCGGAGACAGUGUACAG | 12065 | uuccGGAGAcAGuGuAcAGdTsdT | sense |
| 1929-1948 | 10066 | CUGUACACUGUCUCCGGAA | 12066 | CUGuAcACUGUCUCCGGAAdTsdT | antis |
| 1933-1952 | 10067 | GGAGACAGUGUACAGAGUC | 12067 | GGAGAcAGuGuAcAGAGucdTsdT | sense |
| 1933-1952 | 10068 | GACUCUGUACACUGUCUCC | 12068 | GACUCUGuAcACUGUCUCCdTsdT | antis |
| 1935-1954 | 10069 | AGACAGUGUACAGAGUCGC | 12069 | AGAcAGuGuAcAGAGucGcdTsdT | sense |
| 1935-1954 | 10070 | GCGACUCUGUACACUGUCU | 12070 | GCGACUCUGuAcACUGUCUdTsdT | antis |
| 1941-1960 | 10071 | UGUACAGAGUCGCCAGACA | 12071 | uGuAcAGAGucGccAGAcAdTsdT | sense |
| 1941-1960 | 10072 | UGUCUGGCGACUCUGUACA | 12072 | UGUCUGGCGACUCUGuAcAdTsdT | antis |
| 1944-1963 | 10073 | ACAGAGUCGCCAGACACUA | 12073 | AcAGAGucGccAGAcAcuAdTsdT | sense |
| 1944-1963 | 10074 | UAGUGUCUGGCGACUCUGU | 12074 | uAGUGUCUGGCGACUCUGUdTsdT | antis |
| 1945-1964 | 10075 | CAGAGUCGCCAGACACUAU | 12075 | cAGAGucGccAGAcAcuAudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1945-1964 | 10076 | AUAGUGUCUGGCGACUCUG | 12076 | AuAGUGUCUGGCGACUCUGdTsdT | antis |
| 1965-1984 | 10077 | GUCGAGCCAAGCAGACACU | 12077 | GucGAGccAAGcAGAcAcudTsdT | sense |
| 1965-1984 | 10078 | AGUGUCUGCUUGGCUCGAC | 12078 | AGUGUCUGCUUGGCUCGACdTsdT | antis |
| 1966-1985 | 10079 | UCGAGCCAAGCAGACACUC | 12079 | ucGAGccAAGcAGAcAcucdTsdT | sense |
| 1966-1985 | 10080 | GAGUGUCUGCUUGGCUCGA | 12080 | GAGUGUCUGCUUGGCUCGAdTsdT | antis |
| 1967-1986 | 10081 | CGAGCCAAGCAGACACUCC | 12081 | cGAGccAAGcAGAcAcuccdTsdT | sense |
| 1967-1986 | 10082 | GGAGUGUCUGCUUGGCUCG | 12082 | GGAGUGUCUGCUUGGCUCGdTsdT | antis |
| 1970-1989 | 10083 | GCCAAGCAGACACUCCCUG | 12083 | GccAAGcAGAcAcucccuGdTsdT | sense |
| 1970-1989 | 10084 | CAGGGAGUGUCUGCUUGGC | 12084 | cAGGGAGUGUCUGCUUGGCdTsdT | antis |
| 1971-1990 | 10085 | CCAAGCAGACACUCCCUGU | 12085 | ccAAGcAGAcAcucccuGudTsdT | sense |
| 1971-1990 | 10086 | ACAGGGAGUGUCUGCUUGG | 12086 | AcAGGGAGUGUCUGCUUGGdTsdT | antis |
| 1974-1993 | 10087 | AGCAGACACUCCCUGUGAU | 12087 | AGcAGAcAcucccuGuGAudTsdT | sense |
| 1974-1993 | 10088 | AUCACAGGGAGUGUCUGCU | 12088 | AUcAcAGGGAGUGUCUGCUdTsdT | antis |
| 1975-1994 | 10089 | GCAGACACUCCCUGUGAUC | 12089 | GcAGAcAcucccuGuGAucdTsdT | sense |
| 1975-1994 | 10090 | GAUCACAGGGAGUGUCUGC | 12090 | GAUcAcAGGGAGUGUCUGCdTsdT | antis |
| 1986-2005 | 10091 | CUGUGAUCUAUGUCAAGUU | 12091 | cuGuGAucuAuGucAAGuudTsdT | sense |
| 1986-2005 | 10092 | AACUUGACAUAGAUCACAG | 12092 | AACUUGAcAuAGAUcAcAGdTsdT | antis |
| 1993-2012 | 10093 | CUAUGUCAAGUUGUAUAUG | 12093 | cuAuGucAAGuuGuAuAuGdTsdT | sense |
| 1993-2012 | 10094 | CAUAUACAACUUGACAUAG | 12094 | cAuAuAcAACUUGAcAuAGdTsdT | antis |
| 1995-2014 | 10095 | AUGUCAAGUUGUAUAUGUA | 12095 | AuGucAAGuuGuAuAuGuAdTsdT | sense |
| 1995-2014 | 10096 | UACAUAUACAACUUGACAU | 12096 | uAcAuAuAcAACUUGAcAUdTsdT | antis |
| 1996-2015 | 10097 | UGUCAAGUUGUAUAUGUAU | 12097 | uGucAAGuuGuAuAuGuAudTsdT | sense |
| 1996-2015 | 10098 | AUACAUAUACAACUUGACA | 12098 | AuAcAuAuAcAACUUGAcAdTsdT | antis |
| 1999-2018 | 10099 | CAAGUUGUAUAUGUAUCAG | 12099 | cAAGuuGuAuAuGuAucAGdTsdT | sense |
| 1999-2018 | 10100 | CUGAUACAUAUACAACUUG | 12100 | CUGAuAcAuAuAcAACUUGdTsdT | antis |
| 2009-2028 | 10101 | AUGUAUCAGCUGUUCAGAA | 12101 | AuGuAucAGcuGuucAGAAdTsdT | sense |
| 2009-2028 | 10102 | UUCUGAACAGCUGAUACAU | 12102 | UUCUGAAcAGCUGAuAcAUdTsdT | antis |
| 2010-2029 | 10103 | UGUAUCAGCUGUUCAGAAG | 12103 | uGuAucAGcuGuucAGAAGdTsdT | sense |
| 2010-2029 | 10104 | CUUCUGAACAGCUGAUACA | 12104 | CUUCUGAAcAGCUGAuAcAdTsdT | antis |
| 2016-2035 | 10105 | AGCUGUUCAGAAGUCUAGC | 12105 | AGcuGuucAGAAGucuAGcdTsdT | sense |
| 2016-2035 | 10106 | GCUAGACUUCUGAACAGCU | 12106 | GCuAGACUUCUGAAcAGCUdTsdT | antis |
| 2035-2054 | 10107 | CUAUAUCCAUUCCUUUGGA | 12107 | cuAuAuccAuuccuuuGGAdTsdT | sense |
| 2035-2054 | 10108 | UCCAAAGGAAUGGAUAUAG | 12108 | UCcAAAGGAAUGGAuAuAGdTsdT | antis |
| 2036-2055 | 10109 | UAUAUCCAUUCCUUUGGAA | 12109 | uAuAuccAuuccuuuGGAAdTsdT | sense |
| 2036-2055 | 10110 | UUCCAAAGGAAUGGAUAUA | 12110 | UUCcAAAGGAAUGGAuAuAdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2046-2065 | 10111 | CCUUUGGAAUCUGCCAUCG | 12111 | ccuuuGGAAucuGccAucGdTsdT | sense |
| 2046-2065 | 10112 | CGAUGGCAGAUUCCAAAGG | 12112 | CGAUGGcAGAUUCcAAAGGdTsdT | antis |
| 2049-2068 | 10113 | UUGGAAUCUGCCAUCGAGA | 12113 | uuGGAAucuGccAucGAGAdTsdT | sense |
| 2049-2068 | 10114 | UCUCGAUGGCAGAUUCCAA | 12114 | UCUCGAUGGcAGAUUCcAAdTsdT | antis |
| 2051-2070 | 10115 | GGAAUCUGCCAUCGAGACA | 12115 | GGAAucuGccAucGAGAcAdTsdT | sense |
| 2051-2070 | 10116 | UGUCUCGAUGGCAGAUUCC | 12116 | UGUCUCGAUGGcAGAUUCCdTsdT | antis |
| 2068-2087 | 10117 | CAUUAAACCACAGAACCUC | 12117 | cAuuAAAccAcAGAAccucdTsdT | sense |
| 2068-2087 | 10118 | GAGGUUCUGUGGUUUAAUG | 12118 | GAGGUUCUGUGGUUuAAUGdTsdT | antis |
| 2070-2089 | 10119 | UUAAACCACAGAACCUCUU | 12119 | uuAAAccAcAGAAccucuudTsdT | sense |
| 2070-2089 | 10120 | AAGAGGUUCUGUGGUUUAA | 12120 | AAGAGGUUCUGUGGUUuAAdTsdT | antis |
| 2071-2090 | 10121 | UAAACCACAGAACCUCUUG | 12121 | uAAAccAcAGAAccucuuGdTsdT | sense |
| 2071-2090 | 10122 | CAAGAGGUUCUGUGGUUUA | 12122 | cAAGAGGUUCUGUGGUUuAdTsdT | antis |
| 2073-2092 | 10123 | AACCACAGAACCUCUUGUU | 12123 | AAccAcAGAAccucuuGuudTsdT | sense |
| 2073-2092 | 10124 | AACAAGAGGUUCUGUGGUU | 12124 | AAcAAGAGGUUCUGUGGUUdTsdT | antis |
| 2075-2094 | 10125 | CCACAGAACCUCUUGUUGG | 12125 | ccAcAGAAccucuuGuuGGdTsdT | sense |
| 2075-2094 | 10126 | CCAACAAGAGGUUCUGUGG | 12126 | CcAAcAAGAGGUUCUGUGGdTsdT | antis |
| 2076-2095 | 10127 | CACAGAACCUCUUGUUGGA | 12127 | cAcAGAAccucuuGuuGGAdTsdT | sense |
| 2076-2095 | 10128 | UCCAACAAGAGGUUCUGUG | 12128 | UCcAAcAAGAGGUUCUGUGdTsdT | antis |
| 2078-2097 | 10129 | CAGAACCUCUUGUUGGAUC | 12129 | cAGAAccucuuGuuGGAucdTsdT | sense |
| 2078-2097 | 10130 | GAUCCAACAAGAGGUUCUG | 12130 | GAUCcAAcAAGAGGUUCUGdTsdT | antis |
| 2084-2103 | 10131 | CUCUUGUUGGAUCCUGAUA | 12131 | cucuuGuuGGAuccuGAuAdTsdT | sense |
| 2084-2103 | 10132 | UAUCAGGAUCCAACAAGAG | 12132 | uAUcAGGAUCcAAcAAGAGdTsdT | antis |
| 2086-2105 | 10133 | CUUGUUGGAUCCUGAUACA | 12133 | cuuGuuGGAuccuGAuAcAdTsdT | sense |
| 2086-2105 | 10134 | UGUAUCAGGAUCCAACAAG | 12134 | UGuAUcAGGAUCcAAcAAGdTsdT | antis |
| 2095-2114 | 10135 | UCCUGAUACAGCUGUAUUA | 12135 | uccuGAuAcAGcuGuAuuAdTsdT | sense |
| 2095-2114 | 10136 | UAAUACAGCUGUAUCAGGA | 12136 | uAAuAcAGCUGuAUcAGGAdTsdT | antis |
| 2102-2121 | 10137 | ACAGCUGUAUUAAAACUCU | 12137 | AcAGcuGuAuuAAAAcucudTsdT | sense |
| 2102-2121 | 10138 | AGAGUUUUAAUACAGCUGU | 12138 | AGAGUUUuAAuAcAGCUGUdTsdT | antis |
| 2103-2122 | 10139 | CAGCUGUAUUAAAACUCUG | 12139 | cAGcuGuAuuAAAAcucuGdTsdT | sense |
| 2103-2122 | 10140 | CAGAGUUUUAAUACAGCUG | 12140 | cAGAGUUUuAAuAcAGCUGdTsdT | antis |
| 2105-2124 | 10141 | GCUGUAUUAAAACUCUGUG | 12141 | GcuGuAuuAAAAcucuGuGdTsdT | sense |
| 2105-2124 | 10142 | CACAGAGUUUUAAUACAGC | 12142 | cAcAGAGUUUuAAuAcAGCdTsdT | antis |
| 2106-2125 | 10143 | CUGUAUUAAAACUCUGUGA | 12143 | cuGuAuuAAAAcucuGuGAdTsdT | sense |
| 2106-2125 | 10144 | UCACAGAGUUUUAAUACAG | 12144 | UcAcAGAGUUUuAAuAcAGdTsdT | antis |
| 2108-2127 | 10145 | GUAUUAAAACUCUGUGACU | 12145 | GuAuuAAAAcucuGuGAcudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2108-2127 | 10146 | AGUCACAGAGUUUUAAUAC | 12146 | AGUcAcAGAGUUUuAAuACdTsdT | antis |
| 2115-2134 | 10147 | AACUCUGUGACUUUGGAAG | 12147 | AAcucuGuGAcuuuGGAAGdTsdT | sense |
| 2115-2134 | 10148 | CUUCCAAAGUCACAGAGUU | 12148 | CUUCcAAAGUcAcAGAGUUdTsdT | antis |
| 2120-2139 | 10149 | UGUGACUUUGGAAGUGCAA | 12149 | uGuGAcuuuGGAAGuGcAAdTsdT | sense |
| 2120-2139 | 10150 | UUGCACUUCCAAAGUCACA | 12150 | UUGcACUUCcAAAGUcAcAdTsdT | antis |
| 2124-2143 | 10151 | ACUUUGGAAGUGCAAAGCA | 12151 | AcuuuGGAAGuGcAAAGcAdTsdT | sense |
| 2124-2143 | 10152 | UGCUUUGCACUUCCAAAGU | 12152 | UGCUUUGcACUUCcAAAGUdTsdT | antis |
| 2132-2151 | 10153 | AGUGCAAAGCAGCUGGUCC | 12153 | AGuGcAAAGcAGcuGGuccdTsdT | sense |
| 2132-2151 | 10154 | GGACCAGCUGCUUUGCACU | 12154 | GGACcAGCUGCUUUGcACUdTsdT | antis |
| 2134-2153 | 10155 | UGCAAAGCAGCUGGUCCGA | 12155 | uGcAAAGcAGcuGGuccGAdTsdT | sense |
| 2134-2153 | 10156 | UCGGACCAGCUGCUUUGCA | 12156 | UCGGACcAGCUGCUUUGcAdTsdT | antis |
| 2136-2155 | 10157 | CAAAGCAGCUGGUCCGAGG | 12157 | cAAAGcAGcuGGuccGAGGdTsdT | sense |
| 2136-2155 | 10158 | CCUCGGACCAGCUGCUUUG | 12158 | CCUCGGACcAGCUGCUUUGdTsdT | antis |
| 2139-2158 | 10159 | AGCAGCUGGUCCGAGGAGA | 12159 | AGcAGcuGGuccGAGGAGAdTsdT | sense |
| 2139-2158 | 10160 | UCUCCUCGGACCAGCUGCU | 12160 | UCUCCUCGGACcAGCUGCUdTsdT | antis |
| 2140-2159 | 10161 | GCAGCUGGUCCGAGGAGAG | 12161 | GcAGcuGGuccGAGGAGAGdTsdT | sense |
| 2140-2159 | 10162 | CUCUCCUCGGACCAGCUGC | 12162 | CUCUCCUCGGACcAGCUGCdTsdT | antis |
| 2141-2160 | 10163 | CAGCUGGUCCGAGGAGAGC | 12163 | cAGcuGGuccGAGGAGAGcdTsdT | sense |
| 2141-2160 | 10164 | GCUCUCCUCGGACCAGCUG | 12164 | GCUCUCCUCGGACcAGCUGdTsdT | antis |
| 2142-2161 | 10165 | AGCUGGUCCGAGGAGAGCC | 12165 | AGcuGGuccGAGGAGAGccdTsdT | sense |
| 2142-2161 | 10166 | GGCUCUCCUCGGACCAGCU | 12166 | GGCUCUCCUCGGACcAGCUdTsdT | antis |
| 2146-2165 | 10167 | GGUCCGAGGAGAGCCCAAU | 12167 | GGuccGAGGAGAGcccAAudTsdT | sense |
| 2146-2165 | 10168 | AUUGGGCUCUCCUCGGACC | 12168 | AUUGGGCUCUCCUCGGACCdTsdT | antis |
| 2147-2166 | 10169 | GUCCGAGGAGAGCCCAAUG | 12169 | GuccGAGGAGAGcccAAuGdTsdT | sense |
| 2147-2166 | 10170 | CAUUGGGCUCUCCUCGGAC | 12170 | cAUUGGGCUCUCCUCGGACdTsdT | antis |
| 2160-2179 | 10171 | CCAAUGUUUCAUAUAUCUG | 12171 | ccAAuGuuucAuAuAucuGdTsdT | sense |
| 2160-2179 | 10172 | CAGAUAUAUGAAACAUUGG | 12172 | cAGAuAuAUGAAAcAUUGGdTsdT | antis |
| 2189-2208 | 10173 | UACAGGGCACCAGAGUUGA | 12173 | uAcAGGGcAccAGAGuuGAdTsdT | sense |
| 2189-2208 | 10174 | UCAACUCUGGUGCCCUGUA | 12174 | UcAACUCUGGUGCCCUGuAdTsdT | antis |
| 2191-2210 | 10175 | CAGGGCACCAGAGUUGAUC | 12175 | cAGGGcAccAGAGuuGAucdTsdT | sense |
| 2191-2210 | 10176 | GAUCAACUCUGGUGCCCUG | 12176 | GAUcAACUCUGGUGCCCUGdTsdT | antis |
| 2194-2213 | 10177 | GGCACCAGAGUUGAUCUUU | 12177 | GGcAccAGAGuuGAucuuudTsdT | sense |
| 2194-2213 | 10178 | AAAGAUCAACUCUGGUGCC | 12178 | AAAGAUcAACUCUGGUGCCdTsdT | antis |
| 2195-2214 | 10179 | GCACCAGAGUUGAUCUUUG | 12179 | GcAccAGAGuuGAucuuuGdTsdT | sense |
| 2195-2214 | 10180 | CAAAGAUCAACUCUGGUGC | 12180 | cAAAGAUcAACUCUGGUGCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2196-2215 | 10181 | CACCAGAGUUGAUCUUUGG | 12181 | cAccAGAGuuGAucuuuGGdTsdT | sense |
| 2196-2215 | 10182 | CCAAAGAUCAACUCUGGUG | 12182 | CcAAAGAUcAACUCUGGUGdTsdT | antis |
| 2201-2220 | 10183 | GAGUUGAUCUUUGGAGCCA | 12183 | GAGuuGAucuuuGGAGccAdTsdT | sense |
| 2201-2220 | 10184 | UGGCUCCAAAGAUCAACUC | 12184 | UGGCUCcAAAGAUcAACUCdTsdT | antis |
| 2211-2230 | 10185 | UUGGAGCCACUGAUUACAC | 12185 | uuGGAGccAcuGAuuAcAcdTsdT | sense |
| 2211-2230 | 10186 | GUGUAAUCAGUGGCUCCAA | 12186 | GUGuAAUcAGUGGCUCcAAdTsdT | antis |
| 2234-2253 | 10187 | AGUAUAGAUGUAUGGUCUG | 12187 | AGuAuAGAuGuAuGGucuGdTsdT | sense |
| 2234-2253 | 10188 | CAGACCAUACAUCUAUACU | 12188 | cAGACcAuAcAUCuAuACUdTsdT | antis |
| 2238-2257 | 10189 | UAGAUGUAUGGUCUGCAGG | 12189 | uAGAuGuAuGGucuGcAGGdTsdT | sense |
| 2238-2257 | 10190 | CCUGCAGACCAUACAUCUA | 12190 | CCUGcAGACcAuAcAUCuAdTsdT | antis |
| 2240-2259 | 10191 | GAUGUAUGGUCUGCAGGCU | 12191 | GAuGuAuGGucuGcAGGcudTsdT | sense |
| 2240-2259 | 10192 | AGCCUGCAGACCAUACAUC | 12192 | AGCCUGcAGACcAuAcAUCdTsdT | antis |
| 2241-2260 | 10193 | AUGUAUGGUCUGCAGGCUG | 12193 | AuGuAuGGucuGcAGGcuGdTsdT | sense |
| 2241-2260 | 10194 | CAGCCUGCAGACCAUACAU | 12194 | cAGCCUGcAGACcAuAcAUdTsdT | antis |
| 2242-2261 | 10195 | UGUAUGGUCUGCAGGCUGU | 12195 | uGuAuGGucuGcAGGcuGudTsdT | sense |
| 2242-2261 | 10196 | ACAGCCUGCAGACCAUACA | 12196 | AcAGCCUGcAGACcAuAcAdTsdT | antis |
| 2249-2268 | 10197 | UCUGCAGGCUGUGUGUUGG | 12197 | ucuGcAGGcuGuGuGuuGGdTsdT | sense |
| 2249-2268 | 10198 | CCAACACACAGCCUGCAGA | 12198 | CcAAcAcAcAGCCUGcAGAdTsdT | antis |
| 2255-2274 | 10199 | GGCUGUGUGUUGGCUGAAU | 12199 | GGcuGuGuGuuGGcuGAAudTsdT | sense |
| 2255-2274 | 10200 | AUUCAGCCAACACACAGCC | 12200 | AUUcAGCcAAcAcAcAGCCdTsdT | antis |
| 2256-2275 | 10201 | GCUGUGUGUUGGCUGAAUU | 12201 | GcuGuGuGuuGGcuGAAuudTsdT | sense |
| 2256-2275 | 10202 | AAUUCAGCCAACACACAGC | 12202 | AAUUcAGCcAAcAcAcAGCdTsdT | antis |
| 2257-2276 | 10203 | CUGUGUGUUGGCUGAAUUG | 12203 | cuGuGuGuuGGcuGAAuuGdTsdT | sense |
| 2257-2276 | 10204 | CAAUUCAGCCAACACACAG | 12204 | cAAUUcAGCcAAcAcAcAGdTsdT | antis |
| 2259-2278 | 10205 | GUGUGUUGGCUGAAUUGUU | 12205 | GuGuGuuGGcuGAAuuGuudTsdT | sense |
| 2259-2278 | 10206 | AACAAUUCAGCCAACACAC | 12206 | AAcAAUUcAGCcAAcAcACdTsdT | antis |
| 2260-2279 | 10207 | UGUGUUGGCUGAAUUGUUG | 12207 | uGuGuuGGcuGAAuuGuuGdTsdT | sense |
| 2260-2279 | 10208 | CAACAAUUCAGCCAACACA | 12208 | cAAcAAUUcAGCcAAcAcAdTsdT | antis |
| 2271-2290 | 10209 | AAUUGUUGCUAGGACAACC | 12209 | AAuuGuuGcuAGGAcAAccdTsdT | sense |
| 2271-2290 | 10210 | GGUUGUCCUAGCAACAAUU | 12210 | GGUUGUCCuAGcAAcAAUUdTsdT | antis |
| 2280-2299 | 10211 | UAGGACAACCAAUAUUUCC | 12211 | uAGGAcAAccAAuAuuuccdTsdT | sense |
| 2280-2299 | 10212 | GGAAAUAUUGGUUGUCCUA | 12212 | GGAAAuAUUGGUUGUCCuAdTsdT | antis |
| 2284-2303 | 10213 | ACAACCAAUAUUUCCUGGG | 12213 | AcAAccAAuAuuuccuGGGdTsdT | sense |
| 2284-2303 | 10214 | CCCAGGAAAUAUUGGUUGU | 12214 | CCcAGGAAAuAUUGGUUGUdTsdT | antis |
| 2287-2306 | 10215 | ACCAAUAUUUCCUGGGGAC | 12215 | AccAAuAuuuccuGGGGAcdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2287-2306 | 10216 | GUCCCCAGGAAAUAUUGGU | 12216 | GUCCCcAGGAAAuAUUGGUdTsdT | antis |
| 2288-2307 | 10217 | CCAAUAUUUCCUGGGGACA | 12217 | ccAAuAuuuccuGGGGAcAdTsdT | sense |
| 2288-2307 | 10218 | UGUCCCCAGGAAAUAUUGG | 12218 | UGUCCCcAGGAAAuAUUGGdTsdT | antis |
| 2289-2308 | 10219 | CAAUAUUUCCUGGGGACAG | 12219 | cAAuAuuuccuGGGGAcAGdTsdT | sense |
| 2289-2308 | 10220 | CUGUCCCCAGGAAAUAUUG | 12220 | CUGUCCCcAGGAAAuAUUGdTsdT | antis |
| 2290-2309 | 10221 | AAUAUUUCCUGGGGACAGU | 12221 | AAuAuuuccuGGGGAcAGudTsdT | sense |
| 2290-2309 | 10222 | ACUGUCCCCAGGAAAUAUU | 12222 | ACUGUCCCcAGGAAAuAUUdTsdT | antis |
| 2292-2311 | 10223 | UAUUUCCUGGGGACAGUGG | 12223 | uAuuuccuGGGGAcAGuGGdTsdT | sense |
| 2292-2311 | 10224 | CCACUGUCCCCAGGAAAUA | 12224 | CcACUGUCCCcAGGAAAuAdTsdT | antis |
| 2299-2318 | 10225 | UGGGGACAGUGGUGUGGAU | 12225 | uGGGGAcAGuGGuGuGGAudTsdT | sense |
| 2299-2318 | 10226 | AUCCACACCACUGUCCCCA | 12226 | AUCcAcAGGACUGUCCCcAdTsdT | antis |
| 2303-2322 | 10227 | GACAGUGGUGUGGAUCAGU | 12227 | GAcAGuGGuGuGGAucAGudTsdT | sense |
| 2303-2322 | 10228 | ACUGAUCCACACCACUGUC | 12228 | ACUGAUCcAcAGCACUGUCdTsdT | antis |
| 2310-2329 | 10229 | GUGUGGAUCAGUUGGUGGA | 12229 | GuGuGGAucAGuuGGuGGAdTsdT | sense |
| 2310-2329 | 10230 | UCCACCAACUGAUCCACAC | 12230 | UCcACcAACUGAUCcAcACdTsdT | antis |
| 2316-2335 | 10231 | AUCAGUUGGUGGAAAUAAU | 12231 | AucAGuuGGuGGAAAuAAudTsdT | sense |
| 2316-2335 | 10232 | AUUAUUUCCACCAACUGAU | 12232 | AUuAUUUCcACcAACUGAUdTsdT | antis |
| 2324-2343 | 10233 | GUGGAAAUAAUAAAGGUCC | 12233 | GuGGAAAuAAuAAAGGuccdTsdT | sense |
| 2324-2343 | 10234 | GGACCUUUAUUAUUUCCAC | 12234 | GGACCUUuAUuAUUUCcACdTsdT | antis |
| 2327-2346 | 10235 | GAAAUAAUAAAGGUCCUAG | 12235 | GAAAuAAuAAAGGuccuAGdTsdT | sense |
| 2327-2346 | 10236 | CUAGGACCUUUAUUAUUUC | 12236 | CuAGGACCUUuAUuAUUUCdTsdT | antis |
| 2333-2352 | 10237 | AUAAAGGUCCUAGGAACAC | 12237 | AuAAAGGuccuAGGAAcAcdTsdT | sense |
| 2333-2352 | 10238 | GUGUUCCUAGGACCUUUAU | 12238 | GUGUUCcuAGGACCUUuAUdTsdT | antis |
| 2335-2354 | 10239 | AAAGGUCCUAGGAACACCA | 12239 | AAAGGuccuAGGAAcAccAdTsdT | sense |
| 2335-2354 | 10240 | UGGUGUUCCUAGGACCUUU | 12240 | UGGUGUUCcUAGGACCUUUdTsdT | antis |
| 2341-2360 | 10241 | CCUAGGAACACCAACAAGG | 12241 | ccuAGGAAcAccAAcAAGGdTsdT | sense |
| 2341-2360 | 10242 | CCUUGUUGGUGUUCCUAGG | 12242 | CCUUGUUGGUGUUCCuAGGdTsdT | antis |
| 2345-2364 | 10243 | GGAACACCAACAAGGGAGC | 12243 | GGAcAccAAcAAGGGAGcdTsdT | sense |
| 2345-2364 | 10244 | GCUCCCUUGUUGGUGUUCC | 12244 | GCUCCCUUGUUGGUGUUCCdTsdT | antis |
| 2356-2375 | 10245 | AAGGGAGCAAAUUAGAGAA | 12245 | AAGGGAGcAAAuuAGAGAAdTsdT | sense |
| 2356-2375 | 10246 | UUCUCUAAUUUGCUCCCUU | 12246 | UUCUCuAAUUUGCUCCCUUdTsdT | antis |
| 2358-2377 | 10247 | GGGAGCAAAUUAGAGAAAU | 12247 | GGGAGcAAAuuAGAGAAAudTsdT | sense |
| 2358-2377 | 10248 | AUUUCUCUAAUUUGCUCCC | 12248 | AUUUCUCuAAUUUGCUCCCdTsdT | antis |
| 2364-2383 | 10249 | AAAUUAGAGAAAUGAACCC | 12249 | AAAuuAGAGAAAuGAAcccdTsdT | sense |
| 2364-2383 | 10250 | GGGUUCAUUUCUCUAAUUU | 12250 | GGGUUcAUUUCUCuAAUUUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2365-2384 | 10251 | AAUUAGAGAAAUGAACCCA | 12251 | AAuuAGAGAAAuGAAcccAdTsdT | sense |
| 2365-2384 | 10252 | UGGGUUCAUUUCUCUAAUU | 12252 | UGGGUUcAUUUCUCuAAUUdTsdT | antis |
| 2368-2387 | 10253 | UAGAGAAAUGAACCCAAAU | 12253 | uAGAGAAAuGAAcccAAAudTsdT | sense |
| 2368-2387 | 10254 | AUUUGGGUUCAUUUCUCUA | 12254 | AUUUGGGUUcAUUUCUCUAdTsdT | antis |
| 2369-2388 | 10255 | AGAGAAAUGAACCCAAAUU | 12255 | AGAGAAAuGAAcccAAAuudTsdT | sense |
| 2369-2388 | 10256 | AAUUUGGGUUCAUUUCUCU | 12256 | AAUUUGGGUUcAUUUCUCUdTsdT | antis |
| 2371-2390 | 10257 | AGAAAUGAACCCAAAUUAU | 12257 | AGAAAuGAAcccAAAuuAudTsdT | sense |
| 2371-2390 | 10258 | AUAAUUUGGGUUCAUUUCU | 12258 | AuAAUUUGGGUUcAUUUCUdTsdT | antis |
| 2372-2391 | 10259 | GAAAUGAACCCAAAUUAUA | 12259 | GAAAuGAAcccAAAuuAuAdTsdT | sense |
| 2372-2391 | 10260 | UAUAAUUUGGGUUCAUUUC | 12260 | uAuAAUUUGGGUUcAUUUCdTsdT | antis |
| 2374-2393 | 10261 | AAUGAACCCAAAUUAUACA | 12261 | AAuGAAcccAAAuuAuAcAdTsdT | sense |
| 2374-2393 | 10262 | UGUAUAAUUUGGGUUCAUU | 12262 | UGuAuAAUUUGGGUUcAUUdTsdT | antis |
| 2375-2394 | 10263 | AUGAACCCAAAUUAUACAG | 12263 | AuGAAcccAAAuuAuAcAGdTsdT | sense |
| 2375-2394 | 10264 | CUGUAUAAUUUGGGUUCAU | 12264 | CUGuAuAAUUUGGGUUcAUdTsdT | antis |
| 2381-2400 | 10265 | CCAAAUUAUACAGAAUUCA | 12265 | ccAAAuuAuAcAGAAuucAdTsdT | sense |
| 2381-2400 | 10266 | UGAAUUCUGUAUAAUUUGG | 12266 | UGAAUUCUGuAuAAUUUGGdTsdT | antis |
| 2386-2405 | 10267 | UUAUACAGAAUUCAAAUUC | 12267 | uuAuAcAGAAuucAAAuucdTsdT | sense |
| 2386-2405 | 10268 | GAAUUUGAAUUCUGUAUAA | 12268 | GAAUUUGAAUUCUGuAuAAdTsdT | antis |
| 2387-2406 | 10269 | UAUACAGAAUUCAAAUUCC | 12269 | uAuAcAGAAuucAAAuuccdTsdT | sense |
| 2387-2406 | 10270 | GGAAUUUGAAUUCUGUAUA | 12270 | GGAAUUUGAAUUCUGuAuAdTsdT | antis |
| 2388-2407 | 10271 | AUACAGAAUUCAAAUUCCC | 12271 | AuAcAGAAuucAAAuucccdTsdT | sense |
| 2388-2407 | 10272 | GGGAAUUUGAAUUCUGUAU | 12272 | GGGAAUUUGAAUUCUGuAUdTsdT | antis |
| 2396-2415 | 10273 | UUCAAAUUCCCUCAAAUCA | 12273 | uucAAAuucccucAAAucAdTsdT | sense |
| 2396-2415 | 10274 | UGAUUUGAGGGAAUUUGAA | 12274 | UGAUUUGAGGGAAUUUGAAdTsdT | antis |
| 2398-2417 | 10275 | CAAAUUCCCUCAAAUCAAG | 12275 | cAAAuucccucAAAucAAGdTsdT | sense |
| 2398-2417 | 10276 | CUUGAUUUGAGGGAAUUUG | 12276 | CUUGAUUUGAGGGAAUUUGdTsdT | antis |
| 2399-2418 | 10277 | AAAUUCCCUCAAAUCAAGG | 12277 | AAAuucccucAAAucAAGGdTsdT | sense |
| 2399-2418 | 10278 | CCUUGAUUUGAGGGAAUUU | 12278 | CCUUGAUUUGAGGGAAUUUdTsdT | antis |
| 2406-2425 | 10279 | CUCAAAUCAAGGCACAUCC | 12279 | cucAAAucAAGGcAcAuccdTsdT | sense |
| 2406-2425 | 10280 | GGAUGUGCCUUGAUUUGAG | 12280 | GGAUGUGCCUUGAUUUGAGdTsdT | antis |
| 2407-2426 | 10281 | UCAAAUCAAGGCACAUCCU | 12281 | ucAAAucAAGGcAcAuccudTsdT | sense |
| 2407-2426 | 10282 | AGGAUGUGCCUUGAUUUGA | 12282 | AGGAUGUGCCUUGAUUUGAdTsdT | antis |
| 2410-2429 | 10283 | AAUCAAGGCACAUCCUUGG | 12283 | AAucAAGGcAcAuccuuGGdTsdT | sense |
| 2410-2429 | 10284 | CCAAGGAUGUGCCUUGAUU | 12284 | CcAAGGAUGUGCCUUGAUUdTsdT | antis |
| 2411-2430 | 10285 | AUCAAGGCACAUCCUUGGA | 12285 | AucAAGGcAcAuccuuGGAdTsdT | sense |

TABLE 2-continued

Sequences of duplexes targeting Mouse GSK3-beta
Sequences of duplexes targeting mouse GSK3-beta. Target sequence location identifies target sequence in mouse GSK3-beta mRNA NM_019827.6. Sense strand is identical to target sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2411-2430 | 10286 | UCCAAGGAUGUGCCUUGAU | 12286 | UCcAAGGAUGUGCCUUGAUdTsdT | antis |
| 2413-2432 | 10287 | CAAGGCACAUCCUUGGACA | 12287 | cAAGGcAcAuccuuGGAcAdTsdT | sense |
| 2413-2432 | 10288 | UGUCCAAGGAUGUGCCUUG | 12288 | UGUCcAAGGAUGUGCCUUGdTsdT | antis |
| 2415-2434 | 10289 | AGGCACAUCCUUGGACAAA | 12289 | AGGcAcAuccuuGGAcAAAdTsdT | sense |
| 2415-2434 | 10290 | UUUGUCCAAGGAUGUGCCU | 12290 | UUUGUCcAAGGAUGUGCCUdTsdT | antis |
| 2416-2435 | 10291 | GGCACAUCCUUGGACAAAG | 12291 | GGcAcAuccuuGGAcAAAGdTsdT | sense |
| 2416-2435 | 10292 | CUUUGUCCAAGGAUGUGCC | 12292 | CUUUGUCcAAGGAUGUGCCdTsdT | antis |
| 2417-2436 | 10293 | GCACAUCCUUGGACAAAGG | 12293 | GcAcAuccuuGGAcAAAGGdTsdT | sense |
| 2417-2436 | 10294 | CCUUUGUCCAAGGAUGUGC | 12294 | CCUUUGUCcAAGGAUGUGCdTsdT | antis |
| 2418-2437 | 10295 | CACAUCCUUGGACAAAGGU | 12295 | cAcAuccuuGGAcAAAGGudTsdT | sense |
| 2418-2437 | 10296 | ACCUUUGUCCAAGGAUGUG | 12296 | ACCUUUGUCcAAGGAUGUGdTsdT | antis |
| 2420-2439 | 10297 | CAUCCUUGGACAAAGGUCU | 12297 | cAuccuuGGAcAAAGGucudTsdT | sense |
| 2420-2439 | 10298 | AGACCUUUGUCCAAGGAUG | 12298 | AGACCUUUGUCcAAGGAUGdTsdT | antis |
| 2422-2441 | 10299 | UCCUUGGACAAAGGUCUUC | 12299 | uccuuGGAcAAAGGucuucdTsdT | sense |
| 2422-2441 | 10300 | GAAGACCUUUGUCCAAGGA | 12300 | GAAGACCUUUGUCcAAGGAdTsdT | antis |
| 2426-2445 | 10301 | UGGACAAAGGUCUUCCGGC | 12301 | uGGAcAAAGGucuuccGGcdTsdT | sense |
| 2426-2445 | 10302 | GCCGGAAGACCUUUGUCCA | 12302 | GCCGGAAGACCUUUGUCcAdTsdT | antis |
| 2430-2449 | 10303 | CAAAGGUCUUCCGGCCCCG | 12303 | cAAAGGucuuccGGccccGdTsdT | sense |
| 2430-2449 | 10304 | CGGGGCCGGAAGACCUUUG | 12304 | CGGGGCCGGAAGACCUUUGdTsdT | antis |
| 2439-2458 | 10305 | UCCGGCCCCGAACUCCACC | 12305 | uccGGccccGAAcuccAccdTsdT | sense |
| 2439-2458 | 10306 | GGUGGAGUUCGGGGCCGGA | 12306 | GGUGGAGUUCGGGGCCGGAdTsdT | antis |
| 2443-2462 | 10307 | GCCCCGAACUCCACCAGAG | 12307 | GccccGAAcuccAccAGAGdTsdT | sense |
| 2443-2462 | 10308 | CUCUGGUGGAGUUCGGGGC | 12308 | CUCUGGUGGAGUUCGGGGCdTsdT | antis |
| 2444-2463 | 10309 | CCCCGAACUCCACCAGAGG | 12309 | ccccGAAcuccAccAGAGGdTsdT | sense |
| 2444-2463 | 10310 | CCUCUGGUGGAGUUCGGGG | 12310 | CCUCUGGUGGAGUUCGGGGdTsdT | antis |
| 2446-2465 | 10311 | CCGAACUCCACCAGAGGCA | 12311 | ccGAAcuccAccAGAGGcAdTsdT | sense |
| 2446-2465 | 10312 | UGCCUCUGGUGGAGUUCGG | 12312 | UGCCUCUGGUGGAGUUCGGdTsdT | antis |
| 2447-2466 | 10313 | CGAACUCCACCAGAGGCAA | 12313 | cGAAcuccAccAGAGGcAAdTsdT | sense |
| 2447-2466 | 10314 | UUGCCUCUGGUGGAGUUCG | 12314 | UUGCCUCUGGUGGAGUUCGdTsdT | antis |
| 2448-2467 | 10315 | GAACUCCACCAGAGGCAAU | 12315 | GAAcuccAccAGAGGcAAudTsdT | sense |
| 2448-2467 | 10316 | AUUGCCUCUGGUGGAGUUC | 12316 | AUUGCCUCUGGUGGAGUUCdTsdT | antis |
| 2458-2477 | 10317 | AGAGGCAAUUGCACUGUGC | 12317 | AGAGGcAAuuGcAcuGuGcdTsdT | sense |
| 2458-2477 | 10318 | GCACAGUGCAAUUGCCUCU | 12318 | GcAcAGUGcAAUUGCCUCUdTsdT | antis |
| 2459-2478 | 10319 | GAGGCAAUUGCACUGUGCA | 12319 | GAGGcAAuuGcAcuGuGcAdTsdT | sense |
| 2459-2478 | 10320 | UGCACAGUGCAAUUGCCUC | 12320 | UGcAcAGUGcAAUUGCCUCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2461-2480 | 10321 | GGCAAUUGCACUGUGCAGC | 12321 | GGcAAuuGcAcuGuGcAGcdTsdT | sense |
| 2461-2480 | 10322 | GCUGCACAGUGCAAUUGCC | 12322 | GCUGcAcAGUGcAAUUGCCdTsdT | antis |
| 2462-2481 | 10323 | GCAAUUGCACUGUGCAGCC | 12323 | GcAAuuGcAcuGuGcAGccdTsdT | sense |
| 2462-2481 | 10324 | GGCUGCACAGUGCAAUUGC | 12324 | GGCUGcAcAGUGcAAUUGCdTsdT | antis |
| 2464-2483 | 10325 | AAUUGCACUGUGCAGCCGU | 12325 | AAuuGcAcuGuGcAGccGudTsdT | sense |
| 2464-2483 | 10326 | ACGGCUGCACAGUGCAAUU | 12326 | ACGGCUGcAcAGUGcAAUUdTsdT | antis |
| 2465-2484 | 10327 | AUUGCACUGUGCAGCCGUC | 12327 | AuuGcAcuGuGcAGccGucdTsdT | sense |
| 2465-2484 | 10328 | GACGGCUGCACAGUGCAAU | 12328 | GACGGCUGcAcAGUGcAAUdTsdT | antis |
| 2471-2490 | 10329 | CUGUGCAGCCGUCUGCUGG | 12329 | cuGuGcAGccGucuGcuGGdTsdT | sense |
| 2471-2490 | 10330 | CCAGCAGACGGCUGCACAG | 12330 | CcAGcAGACGGCUGcAcAGdTsdT | antis |
| 2485-2504 | 10331 | GCUGGAGUACACACCUACC | 12331 | GcuGGAGuAcAcAccuAccdTsdT | sense |
| 2485-2504 | 10332 | GGUAGGUGUGUACUCCAGC | 12332 | GGuAGGUGUGuACUCcAGCdTsdT | antis |
| 2507-2526 | 10333 | CGGCUAACACCACUGGAAG | 12333 | cGGcuAAcAccAcuGGAAGdTsdT | sense |
| 2507-2526 | 10334 | CUUCCAGUGGUGUUAGCCG | 12334 | CUUCcAGUGGUGUuAGCCGdTsdT | antis |
| 2509-2528 | 10335 | GCUAACACCACUGGAAGCU | 12335 | GcuAAcAccAcuGGAAGcudTsdT | sense |
| 2509-2528 | 10336 | AGCUUCCAGUGGUGUUAGC | 12336 | AGCUUCcAGUGGUGUuAGdTsdT | antis |
| 2510-2529 | 10337 | CUAACACCACUGGAAGCUU | 12337 | cuAAcAccAcuGGAAGcuudTsdT | sense |
| 2510-2529 | 10338 | AAGCUUCCAGUGGUGUUAG | 12338 | AAGCUUCcAGUGGUGUuAGdTsdT | antis |
| 2512-2531 | 10339 | AACACCACUGGAAGCUUGU | 12339 | AAcAccAcuGGAAGcuuGudTsdT | sense |
| 2512-2531 | 10340 | ACAAGCUUCCAGUGGUGUU | 12340 | AcAAGCUUCcAGUGGUGUUdTsdT | antis |
| 2513-2532 | 10341 | ACACCACUGGAAGCUUGUG | 12341 | AcAccAcuGGAAGcuuGuGdTsdT | sense |
| 2513-2532 | 10342 | CACAAGCUUCCAGUGGUGU | 12342 | cAcAAGCUUCcAGUGGUGUdTsdT | antis |
| 2514-2533 | 10343 | CACCACUGGAAGCUUGUGC | 12343 | cAccAcuGGAAGcuuGuGcdTsdT | sense |
| 2514-2533 | 10344 | GCACAAGCUUCCAGUGGUG | 12344 | GcAcAAGCUUCcAGUGGUGdTsdT | antis |
| 2515-2534 | 10345 | ACCACUGGAAGCUUGUGCA | 12345 | AccAcuGGAAGcuuGuGcAdTsdT | sense |
| 2515-2534 | 10346 | UGCACAAGCUUCCAGUGGU | 12346 | UGcAcAAGCUUCcAGUGGUdTsdT | antis |
| 2517-2536 | 10347 | CACUGGAAGCUUGUGCACA | 12347 | cAcuGGAAGcuuGuGcAcAdTsdT | sense |
| 2517-2536 | 10348 | UGUGCACAAGCUUCCAGUG | 12348 | UGUGcAcAAGCUUCcAGUGdTsdT | antis |
| 2519-2538 | 10349 | CUGGAAGCUUGUGCACAUU | 12349 | cuGGAAGcuuGuGcAcAuudTsdT | sense |
| 2519-2538 | 10350 | AAUGUGCACAAGCUUCCAG | 12350 | AAUGUGcAcAAGCUUCcAGdTsdT | antis |
| 2520-2539 | 10351 | UGGAAGCUUGUGCACAUUC | 12351 | uGGAAGcuuGuGcAcAuucdTsdT | sense |
| 2520-2539 | 10352 | GAAUGUGCACAAGCUUCCA | 12352 | GAAUGUGcAcAAGCUUCcAdTsdT | antis |
| 2521-2540 | 10353 | GGAAGCUUGUGCACAUUCA | 12353 | GGAAGcuuGuGcAcAuucAdTsdT | sense |
| 2521-2540 | 10354 | UGAAUGUGCACAAGCUUCC | 12354 | UGAAUGUGcAcAAGCUUCCdTsdT | antis |
| 2522-2541 | 10355 | GAAGCUUGUGCACAUUCAU | 12355 | GAAGcuuGuGcAcAuucAudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2522-2541 | 10356 | AUGAAUGUGCACAAGCUUC | 12356 | AUGAAUGUGcAcAAGCUUCdTsdT | antis |
| 2524-2543 | 10357 | AGCUUGUGCACAUUCAUUU | 12357 | AGcuuGuGcAcAuucAuuudTsdT | sense |
| 2524-2543 | 10358 | AAAUGAAUGUGCACAAGCU | 12358 | AAAUGAAUGUGcAcAAGCUdTsdT | antis |
| 1560-1579 | 10359 | AGAGCUGCAAGCCAGUGCA | 12359 | AGAGcuGcAAGccAGuGcAdTsdT | sense |
| 1560-1579 | 10360 | UGCACUGGCUUGCAGCUCU | 12360 | UGcACUGGCUUGcAGCUCUdTsdT | antis |
| 1561-1580 | 10361 | GAGCUGCAAGCCAGUGCAG | 12361 | GAGcuGcAAGccAGuGcAGdTsdT | sense |
| 1561-1580 | 10362 | CUGCACUGGCUUGCAGCUC | 12362 | CUGcACUGGCUUGcAGCUCdTsdT | antis |
| 1575-1594 | 10363 | UGCAGCAGCCUUCAGCUUU | 12363 | uGcAGcAGccuucAGcuuudTsdT | sense |
| 1575-1594 | 10364 | AAAGCUGAAGGCUGCUGCA | 12364 | AAAGCUGAAGGCUGCUGcAdTsdT | antis |
| 1611-1630 | 10365 | GCAGAGAUAAAGAUGGCAG | 12365 | GcAGAGAuAAAGAuGGcAGdTsdT | sense |
| 1611-1630 | 10366 | CUGCCAUCUUUAUCUCUGC | 12366 | CUGCcAUCUUuAUCUCUGCdTsdT | antis |
| 1661-1680 | 10367 | CAGGGUCCUGACAGGCCAC | 12367 | cAGGGuccuGAcAGGccAcdTsdT | sense |
| 1661-1680 | 10368 | GUGGCCUGUCAGGACCCUG | 12368 | GUGGCCUGUcAGGACCCUGdTsdT | antis |
| 1779-1798 | 10369 | AGAAAGUUCUACAGGACAA | 12369 | AGAAAGuucuAcAGGAcAAdTsdT | sense |
| 1779-1798 | 10370 | UUGUCCUGUAGAACUUUCU | 12370 | UUGUCCUGuAGAACUUUCUdTsdT | antis |
| 1917-1936 | 10371 | UGCUGGACUAUGUUCCGGA | 12371 | uGcuGGAcuAuGuuccGGAdTsdT | sense |
| 1917-1936 | 10372 | UCCGGAACAUAGUCCAGCA | 12372 | UCCGGAAcAuAGUCcAGcAdTsdT | antis |
| 2012-2031 | 10373 | UAUCAGCUGUUCAGAAGUC | 12373 | uAucAGcuGuucAGAAGucdTsdT | sense |
| 2012-2031 | 10374 | GACUUCUGAACAGCUGAUA | 12374 | GACUUCUGAAcAGCUGAuAdTsdT | antis |
| 2042-2061 | 10375 | CAUUCCUUUGGAAUCUGCC | 12375 | cAuuccuuuGGAAucuGccdTsdT | sense |
| 2042-2061 | 10376 | GGCAGAUUCCAAAGGAAUG | 12376 | GGcAGAUUCcAAAGGAAUGdTsdT | antis |
| 2053-2072 | 10377 | AAUCUGCCAUCGAGACAUU | 12377 | AAucuGccAucGAGAcAuudTsdT | sense |
| 2053-2072 | 10378 | AAUGUCUCGAUGGCAGAUU | 12378 | AAUGUCUCGAUGGcAGAUUdTsdT | antis |
| 2066-2085 | 10379 | GACAUUAAACCACAGAACC | 12379 | GAcAuuAAAccAcAGAAccdTsdT | sense |
| 2066-2085 | 10380 | GGUUCUGUGGUUUAAUGUC | 12380 | GGUUCUGUGGUUuAAUGUCdTsdT | antis |
| 2149-2168 | 10381 | CCGAGGAGAGCCCAAUGUU | 12381 | ccGAGGAGAGcccAAuGuudTsdT | sense |
| 2149-2168 | 10382 | AACAUUGGGCUCUCCUCGG | 12382 | AAcAUUGGGCUCUCCUCGGdTsdT | antis |
| 2248-2267 | 10383 | GUCUGCAGGCUGUGUGUUG | 12383 | GucuGcAGGcuGuGuGuuGdTsdT | sense |
| 2248-2267 | 10384 | CAACACACAGCCUGCAGAC | 12384 | cAAcAcAcAGCCUGcAGACdTsdT | antis |
| 2302-2321 | 10385 | GGACAGUGGUGUGGAUCAG | 12385 | GGAcAGuGGuGuGGAucAGdTsdT | sense |
| 2302-2321 | 10386 | CUGAUCCACACCACUGUCC | 12386 | CUGAUCcAcACcACUGUCCdTsdT | antis |
| 2330-2349 | 10387 | AUAAUAAAGGUCCUAGGAA | 12387 | AuAAuAAAGGuccuAGGAAdTsdT | sense |
| 2330-2349 | 10388 | UUCCUAGGACCUUUAUUAU | 12388 | UUCCuAGGACCUUuAUuAUdTsdT | antis |
| 2362-2381 | 10389 | GCAAAUUAGAGAAAUGAAC | 12389 | GcAAAuuAGAGAAAuGAAcdTsdT | sense |
| 2362-2381 | 10390 | GUUCAUUUCUCUAAUUUGC | 12390 | GUUcAUUUCUCuAAUUUGCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2366-2385 | 10391 | AUUAGAGAAAUGAACCCAA | 12391 | AuuAGAGAAAuGAAcccAAdTsdT | sense |
| 2366-2385 | 10392 | UUGGGUUCAUUUCUCUAAU | 12392 | UUGGGUUcAUUUCUCuAAUdTsdT | antis |
| 2378-2397 | 10393 | AACCCAAAUUAUACAGAAU | 12393 | AAcccAAAuuAuAcAGAAudTsdT | sense |
| 2378-2397 | 10394 | AUUCUGUAUAAUUUGGGUU | 12394 | AUUCUGuAuAAUUUGGGUUdTsdT | antis |
| 2432-2451 | 10395 | AAGGUCUUCCGGCCCCGAA | 12395 | AAGGucuuccGGccccGAAdTsdT | sense |
| 2432-2451 | 10396 | UUCGGGGCCGGAAGACCUU | 12396 | UUCGGGGCCGGAAGACCUUdTsdT | antis |
| 2441-2460 | 10397 | CGGCCCCGAACUCCACCAG | 12397 | cGGccccGAAcuccAccAGdTsdT | sense |
| 2441-2460 | 10398 | CUGGUGGAGUUCGGGGCCG | 12398 | CUGGUGGAGUUCGGGGCCGdTsdT | antis |
| 2456-2475 | 10399 | CCAGAGGCAAUUGCACUGU | 12399 | ccAGAGGcAAuuGcAcuGudTsdT | sense |
| 2456-2475 | 10400 | ACAGUGCAAUUGCCUCUGG | 12400 | AcAGUGcAAUUGCCUCUGGdTsdT | antis |
| 2472-2491 | 10401 | UGUGCAGCCGUCUGCUGGA | 12401 | uGuGcAGccGucuGcuGGAdTsdT | sense |
| 2472-2491 | 10402 | UCCAGCAGACGGCUGCACA | 12402 | UCcAGcAGACGGCUGcAcAdTsdT | antis |
| 1538-1557 | 10403 | CCGAGAACCACCUCCUUUG | 12403 | ccGAGAAccAccuccuuuGdTsdT | sense |
| 1538-1557 | 10404 | CAAAGGAGGUGGUUCUCGG | 12404 | cAAAGGAGGUGGUUCUCGGdTsdT | antis |
| 1539-1558 | 10405 | CGAGAACCACCUCCUUUGC | 12405 | cGAGAAccAccuccuuuGcdTsdT | sense |
| 1539-1558 | 10406 | GCAAAGGAGGUGGUUCUCG | 12406 | GcAAAGGAGGUGGUUCUCGdTsdT | antis |
| 1547-1566 | 10407 | ACCUCCUUUGCGGAGAGCU | 12407 | AccuccuuuGcGGAGAGcudTsdT | sense |
| 1547-1566 | 10408 | AGCUCUCCGCAAAGGAGGU | 12408 | AGCUCUCCGcAAAGGAGGUdTsdT | antis |
| 1551-1570 | 10409 | CCUUUGCGGAGAGCUGCAA | 12409 | ccuuuGcGGAGAGcuGcAAdTsdT | sense |
| 1551-1570 | 10410 | UUGCAGCUCUCCGCAAAGG | 12410 | UUGcAGCUCUCCGcAAAGGdTsdT | antis |
| 1558-1577 | 10411 | GGAGAGCUGCAAGCCAGUG | 12411 | GGAGAGcuGcAAGccAGuGdTsdT | sense |
| 1558-1577 | 10412 | CACUGGCUUGCAGCUCUCC | 12412 | cACUGGCUUGcAGCUCUCCdTsdT | antis |
| 1573-1592 | 10413 | AGUGCAGCAGCCUUCAGCU | 12413 | AGuGcAGcAGccuucAGcudTsdT | sense |
| 1573-1592 | 10414 | AGCUGAAGGCUGCUGCACU | 12414 | AGCUGAAGGCUGCUGcACUdTsdT | antis |
| 1574-1593 | 10415 | GUGCAGCAGCCUUCAGCUU | 12415 | GuGcAGcAGccuucAGcuudTsdT | sense |
| 1574-1593 | 10416 | AAGCUGAAGGCUGCUGCAC | 12416 | AAGCUGAAGGCUGCUGcACdTsdT | antis |
| 1584-1603 | 10417 | CUUCAGCUUUUGGUAGCAU | 12417 | cuucAGcuuuuGGuAGcAudTsdT | sense |
| 1584-1603 | 10418 | AUGCUACCAAAAGCUGAAG | 12418 | AUGCuAccAAAAGCUGAAGdTsdT | antis |
| 1594-1613 | 10419 | UGGUAGCAUGAAAGUUAGC | 12419 | uGGuAGcAuGAAAGuuAGcdTsdT | sense |
| 1594-1613 | 10420 | GCUAACUUUCAUGCUACCA | 12420 | GCuAACUUUcAUGCuAccAdTsdT | antis |
| 1599-1618 | 10421 | GCAUGAAAGUUAGCAGAGA | 12421 | GcAuGAAAGuuAGcAGAGAdTsdT | sense |
| 1599-1618 | 10422 | UCUCUGCUAACUUUCAUGC | 12422 | UCUCUGCuAACUUUcAUGCdTsdT | antis |
| 1600-1619 | 10423 | CAUGAAAGUUAGCAGAGAU | 12423 | cAuGAAAGuuAGcAGAGAudTsdT | sense |
| 1600-1619 | 10424 | AUCUCUGCUAACUUUCAUG | 12424 | AUCUCUGCuAACUUUcAUGdTsdT | antis |
| 1613-1632 | 10425 | AGAGAUAAAGAUGGCAGCA | 12425 | AGAGAuAAAGAuGGcAGcAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1613-1632 | 10426 | UGCUGCCAUCUUUAUCUCU | 12426 | UGCUGCcAUCUUuAUCUCUdTsdT | antis |
| 1614-1633 | 10427 | GAGAUAAAGAUGGCAGCAA | 12427 | GAGAuAAAGAuGGcAGcAAdTsdT | sense |
| 1614-1633 | 10428 | UUGCUGCCAUCUUUAUCUC | 12428 | UUGCUGCcAUCUUuAUCUCdTsdT | antis |
| 1630-1649 | 10429 | CAAGGUAACCACAGUAGUG | 12429 | cAAGGuAAccAcAGuAGuGdTsdT | sense |
| 1630-1649 | 10430 | CACUACUGUGGUUACCUUG | 12430 | cACuACUGUGGUuACCUUGdTsdT | antis |
| 1650-1669 | 10431 | CAACUCCUGGCCAGGGUCC | 12431 | cAAcuccuGGccAGGGuccdTsdT | sense |
| 1650-1669 | 10432 | GGACCCUGGCCAGGAGUUG | 12432 | GGACCCUGGCcAGGAGUUGdTsdT | antis |
| 1652-1671 | 10433 | ACUCCUGGCCAGGGUCCUG | 12433 | AcuccuGGccAGGGuccuGdTsdT | sense |
| 1652-1671 | 10434 | CAGGACCCUGGCCAGGAGU | 12434 | cAGGACCCUGGCcAGGAGUdTsdT | antis |
| 1653-1672 | 10435 | CUCCUGGCCAGGGUCCUGA | 12435 | cuccuGGccAGGGuccuGAdTsdT | sense |
| 1653-1672 | 10436 | UCAGGACCCUGGCCAGGAG | 12436 | UcAGGACCCUGGCcAGGAGdTsdT | antis |
| 1654-1673 | 10437 | UCCUGGCCAGGGUCCUGAC | 12437 | uccuGGccAGGGuccuGAcdTsdT | sense |
| 1654-1673 | 10438 | GUCAGGACCCUGGCCAGGA | 12438 | GUcAGGACCCUGGCcAGGAdTsdT | antis |
| 1665-1684 | 10439 | GUCCUGACAGGCCACAGGA | 12439 | GuccuGAcAGGCcAcAGGAdTsdT | sense |
| 1665-1684 | 10440 | UCCUGUGGCCUGUCAGGAC | 12440 | UCCUGUGGCCUGUcAGGACdTsdT | antis |
| 1673-1692 | 10441 | AGGCCACAGGAAGUCAGUU | 12441 | AGGccAcAGGAAGucAGuudTsdT | sense |
| 1673-1692 | 10442 | AACUGACUUCCUGUGGCCU | 12442 | AACUGACUUCCUGUGGCCUdTsdT | antis |
| 1688-1707 | 10443 | AGUUAUACAGACACGAAAG | 12443 | AGuuAuAcAGAcAcGAAAGdTsdT | sense |
| 1688-1707 | 10444 | CUUUCGUGUCUGUAUAACU | 12444 | CUUUCGUGUCUGuAuAACUdTsdT | antis |
| 1743-1762 | 10445 | CCAAACUUUGUGAUUCUGG | 12445 | ccAAAcuuuGuGAuucuGGdTsdT | sense |
| 1743-1762 | 10446 | CCAGAAUCACAAAGUUUGG | 12446 | CcAGAAUcAcAAAGUUUGGdTsdT | antis |
| 1744-1763 | 10447 | CAAACUUUGUGAUUCUGGA | 12447 | cAAAcuuuGuGAuucuGGAdTsdT | sense |
| 1744-1763 | 10448 | UCCAGAAUCACAAAGUUUG | 12448 | UCcAGAAUcAcAAAGUUUGdTsdT | antis |
| 1745-1764 | 10449 | AAACUUUGUGAUUCUGGAG | 12449 | AAAcuuuGuGAuucuGGAGdTsdT | sense |
| 1745-1764 | 10450 | CUCCAGAAUCACAAAGUUU | 12450 | CUCcAGAAUcAcAAAGUUUdTsdT | antis |
| 1746-1765 | 10451 | AACUUUGUGAUUCUGGAGA | 12451 | AAcuuuGuGAuucuGGAGAdTsdT | sense |
| 1746-1765 | 10452 | UCUCCAGAAUCACAAAGUU | 12452 | UCUCcAGAAUcAcAAAGUUdTsdT | antis |
| 1780-1799 | 10453 | GAAAGUUCUACAGGACAAG | 12453 | GAAAGuucuAcAGGAcAAGdTsdT | sense |
| 1780-1799 | 10454 | CUUGUCCUGUAGAACUUUC | 12454 | CUUGUCCUGuAGAACUUUCdTsdT | antis |
| 1781-1800 | 10455 | AAAGUUCUACAGGACAAGC | 12455 | AAAGuucuAcAGGAcAAGcdTsdT | sense |
| 1781-1800 | 10456 | GCUUGUCCUGUAGAACUUU | 12456 | GCUUGUCCUGuAGAACUUUdTsdT | antis |
| 1782-1801 | 10457 | AAGUUCUACAGGACAAGCG | 12457 | AAGuucuAcAGGAcAAGcGdTsdT | sense |
| 1782-1801 | 10458 | CGCUUGUCCUGUAGAACUU | 12458 | CGCUUGUCCUGuAGAACUUdTsdT | antis |
| 1809-1828 | 10459 | ACCGAGAGCUCCAGAUCAU | 12459 | AccGAGAGcuccAGAucAudTsdT | sense |
| 1809-1828 | 10460 | AUGAUCUGGAGCUCUCGGU | 12460 | AUGAUCUGGAGCUCUCGGUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1880-1899 | 10461 | AGUGGUGAGAAGAAAGAUG | 12461 | AGuGGuGAGAAGAAAGAuGdTsdT | sense |
| 1880-1899 | 10462 | CAUCUUUCUUCUCACCACU | 12462 | cAUCUUUCUUCUcAcCACUdTsdT | antis |
| 1885-1904 | 10463 | UGAGAAGAAAGAUGAGGUC | 12463 | uGAGAAGAAAGAuGAGGucdTsdT | sense |
| 1885-1904 | 10464 | GACCUCAUCUUUCUUCUCA | 12464 | GACCUcAUCUUUCUUCUcAdTsdT | antis |
| 1889-1908 | 10465 | AAGAAAGAUGAGGUCUACC | 12465 | AAGAAAGAuGAGGucuAccdTsdT | sense |
| 1889-1908 | 10466 | GGUAGACCUCAUCUUUCUU | 12466 | GGuAGACCUcAUCUUUCUUdTsdT | antis |
| 2043-2062 | 10467 | AUUCCUUUGGAAUCUGCCA | 12467 | AuuccuuuGGAAucuGccAdTsdT | sense |
| 2043-2062 | 10468 | UGGCAGAUUCCAAAGGAAU | 12468 | UGGcAGAUUCcAAAGGAAUdTsdT | antis |
| 2050-2069 | 10469 | UGGAAUCUGCCAUCGAGAC | 12469 | uGGAAucuGccAucGAGAcdTsdT | sense |
| 2050-2069 | 10470 | GUCUCGAUGGCAGAUUCCA | 12470 | GUCUCGAUGGcAGAUUCcAdTsdT | antis |
| 2092-2111 | 10471 | GGAUCCUGAUACAGCUGUA | 12471 | GGAuccuGAuAcAGcuGuAdTsdT | sense |
| 2092-2111 | 10472 | UACAGCUGUAUCAGGAUCC | 12472 | uAcAGCUGuAUcAGGAUCCdTsdT | antis |
| 2116-2135 | 10473 | ACUCUGUGACUUUGGAAGU | 12473 | AcucuGuGAcuuuGGAAGudTsdT | sense |
| 2116-2135 | 10474 | ACUUCCAAAGUCACAGAGU | 12474 | ACUUCcAAAGUcAcAGAGUdTsdT | antis |
| 2143-2162 | 10475 | GCUGGUCCGAGGAGAGCCC | 12475 | GcuGGuccGAGGAGAGcccdTsdT | sense |
| 2143-2162 | 10476 | GGGCUCUCCUCGGACCAGC | 12476 | GGGCUCUCCUCGGACcAGCdTsdT | antis |
| 2159-2178 | 10477 | CCCAAUGUUUCAUAUAUCU | 12477 | cccAAuGuuucAuAuAucudTsdT | sense |
| 2159-2178 | 10478 | AGAUAUAUGAAACAUUGGG | 12478 | AGAuAuAUGAAcAUUGGGdTsdT | antis |
| 2163-2182 | 10479 | AUGUUUCAUAUAUCUGUUC | 12479 | AuGuuucAuAuAucuGuucdTsdT | sense |
| 2163-2182 | 10480 | GAACAGAUAUAUGAAACAU | 12480 | GAAcAGAuAuAUGAAcAUdTsdT | antis |
| 2207-2226 | 10481 | AUCUUUGGAGCCACUGAUU | 12481 | AucuuuGGAGccAcuGAuudTsdT | sense |
| 2207-2226 | 10482 | AAUCAGUGGCUCCAAAGAU | 12482 | AAUcAGUGGCUCcAAAGAUdTsdT | antis |
| 2247-2266 | 10483 | GGUCUGCAGGCUGUGUGUU | 12483 | GGucuGcAGGcuGuGuGuudTsdT | sense |
| 2247-2266 | 10484 | AACACACAGCCUGCAGACC | 12484 | AAcAcAcAGCCUGcAGACCdTsdT | antis |
| 2251-2270 | 10485 | UGCAGGCUGUGUGUUGGCU | 12485 | uGcAGGcuGuGuGuuGGcudTsdT | sense |
| 2251-2270 | 10486 | AGCCAACACACAGCCUGCA | 12486 | AGCcAAcAcAcAGCCUGcAdTsdT | antis |
| 2261-2280 | 10487 | GUGUUGGCUGAAUUGUUGC | 12487 | GuGuuGGcuGAAuuGuuGcdTsdT | sense |
| 2261-2280 | 10488 | GCAACAAUUCAGCCAACAC | 12488 | GcAAcAAUUcAGCcAAcACdTsdT | antis |
| 2298-2317 | 10489 | CUGGGACAGUGGUGUGGA | 12489 | cuGGGGAcAGuGGuGuGGAdTsdT | sense |
| 2298-2317 | 10490 | UCCACACCACUGUCCCCAG | 12490 | UCcAcAcCACUGUCCCcAGdTsdT | antis |
| 2300-2319 | 10491 | GGGGACAGUGGUGUGGAUC | 12491 | GGGGAcAGuGGuGuGGAucdTsdT | sense |
| 2300-2319 | 10492 | GAUCCACACCACUGUCCCC | 12492 | GAUCcAcAcCACUGUCCCCdTsdT | antis |
| 2301-2320 | 10493 | GGGACAGUGGUGUGGAUCA | 12493 | GGGAcAGuGGuGuGGAucAdTsdT | sense |
| 2301-2320 | 10494 | UGAUCCACACCACUGUCCC | 12494 | UGAUCcAcAcCACUGUCCCdTsdT | antis |
| 2319-2338 | 10495 | AGUUGGUGGAAAUAAUAAA | 12495 | AGuuGGuGGAAAuAAuAAAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2319-2338 | 10496 | UUUAUUAUUUCCACCAACU | 12496 | UUuAUuAUUUCcACcAACUdTsdT | antis |
| 2323-2342 | 10497 | GGUGGAAAUAAUAAAGGUC | 12497 | GGuGGAAAuAAuAAAGGucdTsdT | sense |
| 2323-2342 | 10498 | GACCUUUAUUAUUUCCACC | 12498 | GACCUUuAUuAUUUCcACCdTsdT | antis |
| 2325-2344 | 10499 | UGGAAAUAAUAAAGGUCCU | 12499 | uGGAAAuAAuAAAGGuccudTsdT | sense |
| 2325-2344 | 10500 | AGGACCUUUAUUAUUUCCA | 12500 | AGGACCUUuAUuAUUUCcAdTsdT | antis |
| 2363-2382 | 10501 | CAAAUUAGAGAAAUGAACC | 12501 | cAAAuuAGAGAAAuGAAccdTsdT | sense |
| 2363-2382 | 10502 | GGUUCAUUUCUCUAAUUUG | 12502 | GGUUcAUUUCUCuAAUUUGdTsdT | antis |
| 2376-2395 | 10503 | UGAACCCAAAUUAUACAGA | 12503 | uGAAcccAAAuuAuAcAGAdTsdT | sense |
| 2376-2395 | 10504 | UCUGUAUAAUUUGGGUUCA | 12504 | UCUGuAuAAUUUGGGUUcAdTsdT | antis |
| 2377-2396 | 10505 | GAACCCAAAUUAUACAGAA | 12505 | GAAcccAAAuuAuAcAGAAdTsdT | sense |
| 2377-2396 | 10506 | UUCUGUAUAAUUUGGGUUC | 12506 | UUCUGuAuAAUUUGGGUUCdTsdT | antis |
| 2383-2402 | 10507 | AAAUUAUACAGAAUUCAAA | 12507 | AAAuuAuAcAGAAuucAAAdTsdT | sense |
| 2383-2402 | 10508 | UUUGAAUUCUGUAUAAUUU | 12508 | UUUGAAUUCUGuAuAAUUUdTsdT | antis |
| 2391-2410 | 10509 | CAGAAUUCAAAUUCCCUCA | 12509 | cAGAAuucAAAuucccucAdTsdT | sense |
| 2391-2410 | 10510 | UGAGGGAAUUUGAAUUCUG | 12510 | UGAGGGAAUUUGAAUUCUGdTsdT | antis |
| 2394-2413 | 10511 | AAUUCAAAUUCCCUCAAAU | 12511 | AAuucAAAuucccucAAAudTsdT | sense |
| 2394-2413 | 10512 | AUUUGAGGGAAUUUGAAUU | 12512 | AUUUGAGGGAAUUUGAAUUdTsdT | antis |
| 2436-2455 | 10513 | UCUUCCGGCCCCGAACUCC | 12513 | ucuuccGGccccGAAcuccdTsdT | sense |
| 2436-2455 | 10514 | GGAGUUCGGGGCCGGAAGA | 12514 | GGAGUUCGGGGCCGGAAGAdTsdT | antis |
| 2442-2461 | 10515 | GGCCCCGAACUCCACCAGA | 12515 | GGccccGAAcuccAccAGAdTsdT | sense |
| 2442-2461 | 10516 | UCUGGUGGAGUUCGGGGCC | 12516 | UCUGGUGGAGUUCGGGGCCdTsdT | antis |
| 2449-2468 | 10517 | AACUCCACCAGAGGCAAUU | 12517 | AAcuccAccAGAGGcAAuudTsdT | sense |
| 2449-2468 | 10518 | AAUUGCCUCUGGUGGAGUU | 12518 | AAUUGCCUCUGGUGGAGUUdTsdT | antis |
| 2450-2469 | 10519 | ACUCCACCAGAGGCAAUUG | 12519 | AcuccAccAGAGGcAAuuGdTsdT | sense |
| 2450-2469 | 10520 | CAAUUGCCUCUGGUGGAGU | 12520 | cAAUUGCCUCUGGUGGAGUdTsdT | antis |
| 2457-2476 | 10521 | CAGAGGCAAUUGCACUGUG | 12521 | cAGAGGcAAuuGcAcuGuGdTsdT | sense |
| 2457-2476 | 10522 | CACAGUGCAAUUGCCUCUG | 12522 | cAcAGUGcAAUUGCCUCUGdTsdT | antis |
| 2470-2489 | 10523 | ACUGUGCAGCCGUCUGCUG | 12523 | AcuGuGcAGccGucuGcuGdTsdT | sense |
| 2470-2489 | 10524 | CAGCAGACGGCUGCACAGU | 12524 | cAGcAGACGGCUGcAcAGUdTsdT | antis |
| 2473-2492 | 10525 | GUGCAGCCGUCUGCUGGAG | 12525 | GuGcAGccGucuGcuGGAGdTsdT | sense |
| 2473-2492 | 10526 | CUCCAGCAGACGGCUGCAC | 12526 | CUCcAGcAGACGGCUGcACdTsdT | antis |
| 2475-2494 | 10527 | GCAGCCGUCUGCUGGAGUA | 12527 | GcAGccGucuGcuGGAGuAdTsdT | sense |
| 2475-2494 | 10528 | UACUCCAGCAGACGGCUGC | 12528 | uACUCcAGcAGACGGCUGCdTsdT | antis |
| 1612-1631 | 10529 | CAGAGAUAAAGAUGGCAGC | 12529 | cAGAGAuAAAGAuGGcAGcdTsdT | sense |
| 1612-1631 | 10530 | GCUGCCAUCUUUAUCUCUG | 12530 | GCUGCcAUCUUuAUCUCUGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1804-1823 | 10531 | UAAGAACCGAGAGCUCCAG | 12531 | uAAGAAccGAGAGcuccAGdTsdT | sense |
| 1804-1823 | 10532 | CUGGAGCUCUCGGUUCUUA | 12532 | CUGGAGCUCUCGGUUCUuAdTsdT | antis |
| 1805-1824 | 10533 | AAGAACCGAGAGCUCCAGA | 12533 | AAGAAccGAGAGcuccAGAdTsdT | sense |
| 1805-1824 | 10534 | UCUGGAGCUCUCGGUUCUU | 12534 | UCUGGAGCUCUCGGUUCUUdTsdT | antis |
| 1888-1907 | 10535 | GAAGAAAGAUGAGGUCUAC | 12535 | GAAGAAAGAuGAGGucuAcdTsdT | sense |
| 1888-1907 | 10536 | GUAGACCUCAUCUUUCUUC | 12536 | GuAGACCUcAUCUUUCUUCdTsdT | antis |
| 2165-2184 | 10537 | GUUUCAUAUAUCUGUUCUC | 12537 | GuuucAuAuAucuGuucucdTsdT | sense |
| 2165-2184 | 10538 | GAGAACAGAUAUAUGAAAC | 12538 | GAGAAcAGAuAuAUGAAACdTsdT | antis |
| 2332-2351 | 10539 | AAUAAAGGUCCUAGGAACA | 12539 | AAuAAAGGuccuAGGAAcAdTsdT | sense |
| 2332-2351 | 10540 | UGUUCCUAGGACCUUUAUU | 12540 | UGUUCCuAGGACCUUuAUUdTsdT | antis |
| 2518-2537 | 10541 | ACUGGAAGCUUGUGCACAU | 12541 | AcuGGAAGcuuGuGcAcAudTsdT | sense |
| 2518-2537 | 10542 | AUGUGCACAAGCUUCCAGU | 12542 | AUGUGcAcAAGCUUCcAGUdTsdT | antis |
| 1565-1584 | 10543 | UGCAAGCCAGUGCAGCAGC | 12543 | uGcAAGccAGuGcAGcAGcdTsdT | sense |
| 1565-1584 | 10544 | GCUGCUGCACUGGCUUGCA | 12544 | GCUGCUGcACUGGCUUGcAdTsdT | antis |
| 1569-1588 | 10545 | AGCCAGUGCAGCAGCCUUC | 12545 | AGccAGuGcAGcAGccuucdTsdT | sense |
| 1569-1588 | 10546 | GAAGGCUGCUGCACUGGCU | 12546 | GAAGGCUGCUGcACUGGCUdTsdT | antis |
| 1631-1650 | 10547 | AAGGUAACCACAGUAGUGG | 12547 | AAGGuAAccAcAGuAGuGGdTsdT | sense |
| 1631-1650 | 10548 | CCACUACUGUGGUUACCUU | 12548 | CcACuACUGUGGUuACCUUdTsdT | antis |
| 1659-1678 | 10549 | GCCAGGGUCCUGACAGGCC | 12549 | GccAGGGuccuGAcAGGccdTsdT | sense |
| 1659-1678 | 10550 | GGCCUGUCAGGACCCUGGC | 12550 | GGCCUGUcAGGACCCUGGCdTsdT | antis |
| 1711-1730 | 10551 | UGGAAAUGGAUCAUUUGGU | 12551 | uGGAAAuGGAucAuuuGGudTsdT | sense |
| 1711-1730 | 10552 | ACCAAAUGAUCCAUUUCCA | 12552 | ACcAAAUGAUCcAUUUCcAdTsdT | antis |
| 1756-1775 | 10553 | UUCUGGAGAACUGGUUGCC | 12553 | uucuGGAGAAcuGGuuGccdTsdT | sense |
| 1756-1775 | 10554 | GGCAACCAGUUCUCCAGAA | 12554 | GGcAACcAGUUCUCcAGAAdTsdT | antis |
| 1761-1780 | 10555 | GAGAACUGGUUGCCAUCAA | 12555 | GAGAAcuGGuuGccAucAAdTsdT | sense |
| 1761-1780 | 10556 | UUGAUGGCAACCAGUUCUC | 12556 | UUGAUGGcAACcAGUUCUCdTsdT | antis |
| 1762-1781 | 10557 | AGAACUGGUUGCCAUCAAG | 12557 | AGAAcuGGuuGccAucAAGdTsdT | sense |
| 1762-1781 | 10558 | CUUGAUGGCAACCAGUUCU | 12558 | CUUGAUGGcAACcAGUUCUdTsdT | antis |
| 1997-2016 | 10559 | GUCAAGUUGUAUAUGUAUC | 12559 | GucAAGuuGuAuAuGuAucdTsdT | sense |
| 1997-2016 | 10560 | GAUACAUAUACAACUUGAC | 12560 | GAuAcAuAuAcAACUUGACdTsdT | antis |
| 2040-2059 | 10561 | UCCAUUCCUUUGGAAUCUG | 12561 | uccAuuccuuuGGAAucuGdTsdT | sense |
| 2040-2059 | 10562 | CAGAUUCCAAAGGAAUGGA | 12562 | cAGAUUCcAAAGGAAUGGAdTsdT | antis |
| 2133-2152 | 10563 | GUGCAAAGCAGCUGGUCCG | 12563 | GuGcAAAGcAGcuGGuccGdTsdT | sense |
| 2133-2152 | 10564 | CGGACCAGCUGCUUUGCAC | 12564 | CGGAccAGCUGCUUUGcACdTsdT | antis |
| 2186-2205 | 10565 | UACUACAGGGCACCAGAGU | 12565 | uAcuAcAGGGcAccAGAGudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2186-2205 | 10566 | ACUCUGGUGCCCUGUAGUA | 12566 | ACUCUGGUGCCCUGuAGuAdTsdT | antis |
| 2250-2269 | 10567 | CUGCAGGCUGUGUGUUGGC | 12567 | cuGcAGGcuGuGuGuuGGcdTsdT | sense |
| 2250-2269 | 10568 | GCCAACACACAGCCUGCAG | 12568 | GCcAAcAcAcAGCCUGcAGdTsdT | antis |
| 2466-2485 | 10569 | UUGCACUGUGCAGCCGUCU | 12569 | uuGcAcuGuGcAGccGucudTsdT | sense |
| 2466-2485 | 10570 | AGACGGCUGCACAGUGCAA | 12570 | AGACGGCUGcAcAGUGcAAdTsdT | antis |
| 2523-2542 | 10571 | AAGCUUGUGCACAUUCAUU | 12571 | AAGcuuGuGcAcAuucAuudTsdT | sense |
| 2523-2542 | 10572 | AAUGAAUGUGCACAAGCUU | 12572 | AAUGAAUGUGcAcAAGCUUdTsdT | antis |
| 1548-1567 | 10573 | CCUCCUUUGCGGAGAGCUG | 12573 | ccuccuuuGcGGAGAGcuGdTsdT | sense |
| 1548-1567 | 10574 | CAGCUCUCCGCAAAGGAGG | 12574 | cAGCUCUCCGcAAAGGAGGdTsdT | antis |
| 1566-1585 | 10575 | GCAAGCCAGUGCAGCAGCC | 12575 | GcAAGccAGuGcAGcAGccdTsdT | sense |
| 1566-1585 | 10576 | GGCUGCUGCACUGGCUUGC | 12576 | GGCUGCUGcACUGGCUUGCdTsdT | antis |
| 1656-1675 | 10577 | CUGGCCAGGGUCCUGACAG | 12577 | cuGGccAGGGuccuGAcAGdTsdT | sense |
| 1656-1675 | 10578 | CUGUCAGGACCCUGGCCAG | 12578 | CUGUcAGGACCCUGGCcAGdTsdT | antis |
| 1763-1782 | 10579 | GAACUGGUUGCCAUCAAGA | 12579 | GAAcuGGuuGccAucAAGAdTsdT | sense |
| 1763-1782 | 10580 | UCUUGAUGGCAACCAGUUC | 12580 | UCUUGAUGGcAACcAGUUCdTsdT | antis |
| 2185-2204 | 10581 | GUACUACAGGGCACCAGAG | 12581 | GuAcuAcAGGGcAccAGAGdTsdT | sense |
| 2185-2204 | 10582 | CUCUGGUGCCCUGUAGUAC | 12582 | CUCUGGUGCCCUGuAGuACdTsdT | antis |
| 2212-2231 | 10583 | UGGAGCCACUGAUUACACG | 12583 | uGGAGccAcuGAuuAcAcGdTsdT | sense |
| 2212-2231 | 10584 | CGUGUAAUCAGUGGCUCCA | 12584 | CGUGuAAUcAGUGGCUCcAdTsdT | antis |
| 2265-2284 | 10585 | UGGCUGAAUUGUUGCUAGG | 12585 | uGGcuGAAuuGuuGcuAGGdTsdT | sense |
| 2265-2284 | 10586 | CCUAGCAACAAUUCAGCCA | 12586 | CCuAGcAAcAAUUcAGCcAdTsdT | antis |
| 2326-2345 | 10587 | GGAAAUAAUAAAGGUCCUA | 12587 | GGAAAuAAuAAAGGuccuAdTsdT | sense |
| 2326-2345 | 10588 | UAGGACCUUUAUUAUUUCC | 12588 | uAGGACCUUuAUuAUUUCCdTsdT | antis |
| 2425-2444 | 10589 | UUGGACAAAGGUCUUCCGG | 12589 | uuGGAcAAAGGucuuccGGdTsdT | sense |
| 2425-2444 | 10590 | CCGGAAGACCUUUGUCCAA | 12590 | CCGGAAGACCUUUGUCcAAdTsdT | antis |
| 1962-1981 | 10591 | AUAGUCGAGCCAAGCAGAC | 12591 | AuAGucGAGccAAGcAGAcdTsdT | sense |
| 1962-1981 | 10592 | GUCUGCUUGGCUCGACUAU | 12592 | GUCUGCUUGGCUCGACUAUdTsdT | antis |
| 1803-1822 | 10593 | UUAAGAACCGAGAGCUCCA | 12593 | uuAAGAAccGAGAGcuccAdTsdT | sense |
| 1803-1822 | 10594 | UGGAGCUCUCGGUUCUUAA | 12594 | UGGAGCUCUCGGUUCUuAAdTsdT | antis |
| 1808-1827 | 10595 | AACCGAGAGCUCCAGAUCA | 12595 | AAccGAGAGcuccAGAucAdTsdT | sense |
| 1808-1827 | 10596 | UGAUCUGGAGCUCUCGGUU | 12596 | UGAUCUGGAGCUCUCGGUUdTsdT | antis |
| 1603-1622 | 10597 | GAAAGUUAGCAGAGAUAAA | 12597 | GAAAGuuAGcAGAGAuAAAdTsdT | sense |
| 1603-1622 | 10598 | UUUAUCUCUGCUAACUUUC | 12598 | UUuAUCUCUGCuAACUUUCdTsdT | antis |
| 1640-1659 | 10599 | ACAGUAGUGGCAACUCCUG | 12599 | AcAGuAGuGGcAAcuccuGdTsdT | sense |
| 1640-1659 | 10600 | CAGGAGUUGCCACUACUGU | 12600 | cAGGAGUUGCcACuACUGUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1718-1737 | 10601 | GGAUCAUUUGGUGUGGUAU | 12601 | GGAucAuuuGGuGuGGuAudTsdT | sense |
| 1718-1737 | 10602 | AUACCACACCAAAUGAUCC | 12602 | AuACcAcACcAAAUGAUCCdTsdT | antis |
| 1807-1826 | 10603 | GAACCGAGAGCUCCAGAUC | 12603 | GAAccGAGAGcuccAGAucdTsdT | sense |
| 1807-1826 | 10604 | GAUCUGGAGCUCUCGGUUC | 12604 | GAUCUGGAGCUCUCGGUUCdTsdT | antis |
| 1904-1923 | 10605 | UACCUUAACCUGGUGCUGG | 12605 | uAccuuAAccuGGuGcuGGdTsdT | sense |
| 1904-1923 | 10606 | CCAGCACCAGGUUAAGGUA | 12606 | CcAGcACcAGGUuAAGGuAdTsdT | antis |
| 1905-1924 | 10607 | ACCUUAACCUGGUGCUGGA | 12607 | AccuuAAccuGGuGcuGGAdTsdT | sense |
| 1905-1924 | 10608 | UCCAGCACCAGGUUAAGGU | 12608 | UCcAGcACcAGGUuAAGGUdTsdT | antis |
| 1906-1925 | 10609 | CCUUAACCUGGUGCUGGAC | 12609 | ccuuAAccuGGuGcuGGAcdTsdT | sense |
| 1906-1925 | 10610 | GUCCAGCACCAGGUUAAGG | 12610 | GUCcAGcACcAGGUuAAGGdTsdT | antis |
| 2015-2034 | 10611 | CAGCUGUUCAGAAGUCUAG | 12611 | cAGcuGuucAGAAGucuAGdTsdT | sense |
| 2015-2034 | 10612 | CUAGACUUCUGAACAGCUG | 12612 | CuAGACUUCUGAAcAGCUGdTsdT | antis |
| 2057-2076 | 10613 | UGCCAUCGAGACAUUAAAC | 12613 | uGccAucGAGAcAuuAAAcdTsdT | sense |
| 2057-2076 | 10614 | GUUUAAUGUCUCGAUGGCA | 12614 | GUUuAAUGUCUCGAUGGcAdTsdT | antis |
| 2109-2128 | 10615 | UAUUAAAACUCUGUGACUU | 12615 | uAuuAAAAcucuGuGAcuudTsdT | sense |
| 2109-2128 | 10616 | AAGUCACAGAGUUUUAAUA | 12616 | AAGUcAcAGAGUUUuAAuAdTsdT | antis |
| 2126-2145 | 10617 | UUUGGAAGUGCAAAGCAGC | 12617 | uuuGGAAGuGcAAAGcAGcdTsdT | sense |
| 2126-2145 | 10618 | GCUGCUUUGCACUUCCAAA | 12618 | GCUGCUUUGcACUUCcAAAdTsdT | antis |
| 2129-2148 | 10619 | GGAAGUGCAAAGCAGCUGG | 12619 | GGAAGuGcAAAGcAGcuGGdTsdT | sense |
| 2129-2148 | 10620 | CCAGCUGCUUUGCACUUCC | 12620 | CcAGCUGCUUUGcACUUCCdTsdT | antis |
| 2312-2331 | 10621 | GUGGAUCAGUUGGUGGAAA | 12621 | GuGGAucAGuuGGuGGAAAdTsdT | sense |
| 2312-2331 | 10622 | UUUCCACCAACUGAUCCAC | 12622 | UUUCcAccAACUGAUCcACdTsdT | antis |
| 2313-2332 | 10623 | UGGAUCAGUUGGUGGAAAU | 12623 | uGGAucAGuuGGuGGAAAudTsdT | sense |
| 2313-2332 | 10624 | AUUUCCACCAACUGAUCCA | 12624 | AUUUCcACcAACUGAUCcAdTsdT | antis |
| 2347-2366 | 10625 | AACACCAACAAGGGAGCAA | 12625 | AAcAccAAcAAGGGAGcAAdTsdT | sense |
| 2347-2366 | 10626 | UUGCUCCCUUGUUGGUGUU | 12626 | UUGCUCCCUUGUUGGUGUUdTsdT | antis |
| 2373-2392 | 10627 | AAAUGAACCCAAAUUAUAC | 12627 | AAAuGAAcccAAAuuAuAcdTsdT | sense |
| 2373-2392 | 10628 | GUAUAAUUUGGGUUCAUUU | 12628 | GuAuAAUUUGGGUUcAUUUdTsdT | antis |
| 2431-2450 | 10629 | AAAGGUCUUCCGGCCCCGA | 12629 | AAAGGucuuccGGccccGAdTsdT | sense |
| 2431-2450 | 10630 | UCGGGGCCGGAAGACCUUU | 12630 | UCGGGGCCGGAAGACCUUUdTsdT | antis |
| 1632-1651 | 10631 | AGGUAACCACAGUAGUGGC | 12631 | AGGuAAccAcAGuAGuGGcdTsdT | sense |
| 1632-1651 | 10632 | GCCACUACUGUGGUUACCU | 12632 | GCcACuACUGUGGUuACCUdTsdT | antis |
| 2031-2050 | 10633 | UAGCCUAUAUCCAUUCCUU | 12633 | uAGccuAuAuccAuuccuudTsdT | sense |
| 2031-2050 | 10634 | AAGGAAUGGAUAUAGGCUA | 12634 | AAGGAAUGGAuAuAGGCuAdTsdT | antis |
| 1604-1623 | 10635 | AAAGUUAGCAGAGAUAAAG | 12635 | AAAGuuAGcAGAGAuAAAGdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1604-1623 | 10636 | CUUUAUCUCUGCUAACUUU | 12636 | CUUuAUCUCUGCuAACUUUdTsdT | antis |
| 1605-1624 | 10637 | AAGUUAGCAGAGAUAAAGA | 12637 | AAGuuAGcAGAGAuAAAGAdTsdT | sense |
| 1605-1624 | 10638 | UCUUUAUCUCUGCUAACUU | 12638 | UCUUuAUCUCUGCuAACUUdTsdT | antis |
| 1634-1653 | 10639 | GUAACCACAGUAGUGGCAA | 12639 | GuAAccAcAGuAGuGGcAAdTsdT | sense |
| 1634-1653 | 10640 | UUGCCACUACUGUGGUUAC | 12640 | UUGCcACuACUGUGGUuACdTsdT | antis |
| 1662-1681 | 10641 | AGGGUCCUGACAGGCCACA | 12641 | AGGGuccuGAcAGGccAcAdTsdT | sense |
| 1662-1681 | 10642 | UGUGGCCUGUCAGGACCCU | 12642 | UGUGGCCUGUcAGGACCCUdTsdT | antis |
| 1663-1682 | 10643 | GGGUCCUGACAGGCCACAG | 12643 | GGGuccuGAcAGGccAcAGdTsdT | sense |
| 1663-1682 | 10644 | CUGUGGCCUGUCAGGACCC | 12644 | CUGUGGCCUGUcAGGACCCdTsdT | antis |
| 1702-1721 | 10645 | GAAAGUGAUUGGAAAUGGA | 12645 | GAAAGuGAuuGGAAAuGGAdTsdT | sense |
| 1702-1721 | 10646 | UCCAUUUCCAAUCACUUUC | 12646 | UCcAUUUCcAAUcACUUUCdTsdT | antis |
| 1772-1791 | 10647 | GCCAUCAAGAAAGUUCUAC | 12647 | GccAucAAGAAAGuucuAcdTsdT | sense |
| 1772-1791 | 10648 | GUAGAACUUUCUUGAUGGC | 12648 | GuAGAACUUUCUUGAUGGCdTsdT | antis |
| 1776-1795 | 10649 | UCAAGAAAGUUCUACAGGA | 12649 | ucAAGAAAGuucuAcAGGAdTsdT | sense |
| 1776-1795 | 10650 | UCCUGUAGAACUUUCUUGA | 12650 | UCCUGuAGAACUUUCUUGAdTsdT | antis |
| 1792-1811 | 10651 | GGACAAGCGAUUUAAGAAC | 12651 | GGAcAAGcGAuuuAAGAAcdTsdT | sense |
| 1792-1811 | 10652 | GUUCUUAAAUCGCUUGUCC | 12652 | GUUCUuAAAUCGCUUGUCCdTsdT | antis |
| 1801-1820 | 10653 | AUUUAAGAACCGAGAGCUC | 12653 | AuuuAAGAAccGAGAGcucdTsdT | sense |
| 1801-1820 | 10654 | GAGCUCUCGGUUCUUAAAU | 12654 | GAGCUCUCGGUUCUuAAAUdTsdT | antis |
| 1813-1832 | 10655 | AGAGCUCCAGAUCAUGAGA | 12655 | AGAGcuccAGAucAuGAGAdTsdT | sense |
| 1813-1832 | 10656 | UCUCAUGAUCUGGAGCUCU | 12656 | UCUcAUGAUCUGGAGCUCUdTsdT | antis |
| 1859-1878 | 10657 | CUGCGGUAUUUCUUCUACU | 12657 | cuGcGGuAuuucuucuAcudTsdT | sense |
| 1859-1878 | 10658 | AGUAGAAGAAAUACCGCAG | 12658 | AGuAGAAGAAAuACCGcAGdTsdT | antis |
| 1860-1879 | 10659 | UGCGGUAUUUCUUCUACUC | 12659 | uGcGGuAuuucuucuAcucdTsdT | sense |
| 1860-1879 | 10660 | GAGUAGAAGAAAUACCGCA | 12660 | GAGuAGAAGAAAuACCGcAdTsdT | antis |
| 1900-1919 | 10661 | GGUCUACCUUAACCUGGUG | 12661 | GGucuAccuuAAccuGGuGdTsdT | sense |
| 1900-1919 | 10662 | CACCAGGUUAAGGUAGACC | 12662 | cACcAGGUuAAGGuAGACCdTsdT | antis |
| 1909-1928 | 10663 | UAACCUGGUGCUGGACUAU | 12663 | uAAccuGGuGcuGGAcuAudTsdT | sense |
| 1909-1928 | 10664 | AUAGUCCAGCACCAGGUUA | 12664 | AuAGUCcAGcACcAGGUuAdTsdT | antis |
| 1982-2001 | 10665 | CUCCCUGUGAUCUAUGUCA | 12665 | cucccuGuGAucuAuGucAdTsdT | sense |
| 1982-2001 | 10666 | UGACAUAGAUCACAGGGAG | 12666 | UGAcAuAGAUcAcAGGGAGdTsdT | antis |
| 2125-2144 | 10667 | CUUUGGAAGUGCAAAGCAG | 12667 | cuuuGGAAGuGcAAAGcAGdTsdT | sense |
| 2125-2144 | 10668 | CUGCUUUGCACUUCCAAAG | 12668 | CUGCUUUGcACUUCcAAAGdTsdT | antis |
| 2137-2156 | 10669 | AAAGCAGCUGGUCCGAGGA | 12669 | AAAGcAGcuGGuccGAGGAdTsdT | sense |
| 2137-2156 | 10670 | UCCUCGGACCAGCUGCUUU | 12670 | UCCUCGGACcAGCUGCUUUdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2156-2175 | 10671 | GAGCCCAAUGUUUCAUAUA | 12671 | GAGcccAAuGuuucAuAuAdTsdT | sense |
| 2156-2175 | 10672 | UAUAUGAAACAUUGGGCUC | 12672 | uAuAUGAAAcAUUGGGCUCdTsdT | antis |
| 2174-2193 | 10673 | AUCUGUUCUCGGUACUACA | 12673 | AucuGuucucGGuAcuAcAdTsdT | sense |
| 2174-2193 | 10674 | UGUAGUACCGAGAACAGAU | 12674 | UGuAGuACCGAGAAcAGAUdTsdT | antis |
| 2281-2300 | 10675 | AGGACAACCAAUAUUUCCU | 12675 | AGGAcAAccAAuAuuuccudTsdT | sense |
| 2281-2300 | 10676 | AGGAAAUAUUGGUUGUCCU | 12676 | AGGAAAuAUUGGUUGUCCUdTsdT | antis |
| 2282-2301 | 10677 | GGACAACCAAUAUUUCCUG | 12677 | GGAcAAccAAuAuuuccuGdTsdT | sense |
| 2282-2301 | 10678 | CAGGAAAUAUUGGUUGUCC | 12678 | cAGGAAAuAUUGGUUGUCCdTsdT | antis |
| 2317-2336 | 10679 | UCAGUUGGUGGAAAUAAUA | 12679 | ucAGuuGGuGGAAAuAAuAdTsdT | sense |
| 2317-2336 | 10680 | UAUUAUUUCCACCAACUGA | 12680 | uAUuAUUUCcACcAACUGAdTsdT | antis |
| 2346-2365 | 10681 | GAACACCAACAAGGGAGCA | 12681 | GAAcAccAAcAAGGGAGcAdTsdT | sense |
| 2346-2365 | 10682 | UGCUCCCUUGUUGGUGUUC | 12682 | UGCUCCCUUGUUGGUGUUCdTsdT | antis |
| 2401-2420 | 10683 | AUUCCCUCAAAUCAAGGCA | 12683 | AuucccucAAAucAAGGcAdTsdT | sense |
| 2401-2420 | 10684 | UGCCUUGAUUUGAGGGAAU | 12684 | UGCCUUGAUUUGAGGGAAUdTsdT | antis |
| 2402-2421 | 10685 | UUCCCUCAAAUCAAGGCAC | 12685 | uucccucAAAucAAGGcAcdTsdT | sense |
| 2402-2421 | 10686 | GUGCCUUGAUUUGAGGGAA | 12686 | GUGCCUUGAUUUGAGGGAAdTsdT | antis |
| 2463-2482 | 10687 | CAAUUGCACUGUGCAGCCG | 12687 | cAAuuGcAcuGuGcAGccGdTsdT | sense |
| 2463-2482 | 10688 | CGGCUGCACAGUGCAAUUG | 12688 | CGGCUGcAcAGUGcAAUUGdTsdT | antis |
| 1537-1556 | 10689 | ACCGAGAACCACCUCCUUU | 12689 | AccGAGAAccAccuccuuudTsdT | sense |
| 1537-1556 | 10690 | AAAGGAGGUGGUUCUCGGU | 12690 | AAAGGAGGUGGUUCUCGGUdTsdT | antis |
| 1554-1573 | 10691 | UUGCGGAGAGCUGCAAGCC | 12691 | uuGcGGAGAGcuGcAAGccdTsdT | sense |
| 1554-1573 | 10692 | GGCUUGCAGCUCUCCGCAA | 12692 | GGCUUGcAGCUCUCCGcAAdTsdT | antis |
| 1555-1574 | 10693 | UGCGGAGAGCUGCAAGCCA | 12693 | uGcGGAGAGcuGcAAGccAdTsdT | sense |
| 1555-1574 | 10694 | UGGCUUGCAGCUCUCCGCA | 12694 | UGGCUUGcAGCUCUCCGcAdTsdT | antis |
| 1562-1581 | 10695 | AGCUGCAAGCCAGUGCAGC | 12695 | AGcuGcAAGccAGuGcAGcdTsdT | sense |
| 1562-1581 | 10696 | GCUGCACUGGCUUGCAGCU | 12696 | GCUGcACUGGCUUGcAGCUdTsdT | antis |
| 1563-1582 | 10697 | GCUGCAAGCCAGUGCAGCA | 12697 | GcuGcAAGccAGuGcAGcAdTsdT | sense |
| 1563-1582 | 10698 | UGCUGCACUGGCUUGCAGC | 12698 | UGCUGcACUGGCUUGcAGCdTsdT | antis |
| 1570-1589 | 10699 | GCCAGUGCAGCAGCCUUCA | 12699 | GccAGuGcAGcAGccuucAdTsdT | sense |
| 1570-1589 | 10700 | UGAAGGCUGCUGCACUGGC | 12700 | UGAAGGCUGCUGcACUGGCdTsdT | antis |
| 1571-1590 | 10701 | CCAGUGCAGCAGCCUUCAG | 12701 | ccAGuGcAGcAGccuucAGdTsdT | sense |
| 1571-1590 | 10702 | CUGAAGGCUGCUGCACUGG | 12702 | CUGAAGGCUGCUGcACUGGdTsdT | antis |
| 1589-1608 | 10703 | GCUUUUGGUAGCAUGAAAG | 12703 | GcuuuuGGuAGcAuGAAAGdTsdT | sense |
| 1589-1608 | 10704 | CUUUCAUGCUACCAAAAGC | 12704 | CUUUcAUGCuACcAAAAGCdTsdT | antis |
| 1595-1614 | 10705 | GGUAGCAUGAAAGUUAGCA | 12705 | GGuAGcAuGAAAGuuAGcAdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1595-1614 | 10706 | UGCUAACUUUCAUGCUACC | 12706 | UGCuAACUUUcAUGCuACCdTsdT | antis |
| 1596-1615 | 10707 | GUAGCAUGAAAGUUAGCAG | 12707 | GuAGcAuGAAAGuuAGcAGdTsdT | sense |
| 1596-1615 | 10708 | CUGCUAACUUUCAUGCUAC | 12708 | CUGCuAACUUUcAUGCuACdTsdT | antis |
| 1597-1616 | 10709 | UAGCAUGAAAGUUAGCAGA | 12709 | uAGcAuGAAAGuuAGcAGAdTsdT | sense |
| 1597-1616 | 10710 | UCUGCUAACUUUCAUGCUA | 12710 | UCUGCuAACUUUcAUGCuAdTsdT | antis |
| 1606-1625 | 10711 | AGUUAGCAGAGAUAAAGAU | 12711 | AGuuAGcAGAGAuAAAGAudTsdT | sense |
| 1606-1625 | 10712 | AUCUUUAUCUCUGCUAACU | 12712 | AUCUUuAUCUCUGCuAACUdTsdT | antis |
| 1607-1626 | 10713 | GUUAGCAGAGAUAAAGAUG | 12713 | GuuAGcAGAGAuAAAGAuGdTsdT | sense |
| 1607-1626 | 10714 | CAUCUUUAUCUCUGCUAAC | 12714 | cAUCUUuAUCUCUGCuAACdTsdT | antis |
| 1608-1627 | 10715 | UUAGCAGAGAUAAAGAUGG | 12715 | uuAGcAGAGAuAAAGAuGGdTsdT | sense |
| 1608-1627 | 10716 | CCAUCUUUAUCUCUGCUAA | 12716 | CcAUCUUuAUCUCUGCuAAdTsdT | antis |
| 1616-1635 | 10717 | GAUAAAGAUGGCAGCAAGG | 12717 | GAuAAAGAuGGcAGcAAGGdTsdT | sense |
| 1616-1635 | 10718 | CCUUGCUGCCAUCUUUAUC | 12718 | CCUUGCUGCcAUCUUuAUCdTsdT | antis |
| 1617-1636 | 10719 | AUAAAGAUGGCAGCAAGGU | 12719 | AuAAAGAuGGcAGcAAGGudTsdT | sense |
| 1617-1636 | 10720 | ACCUUGCUGCCAUCUUUAU | 12720 | ACCUUGCUGCcAUCUUuAUdTsdT | antis |
| 1638-1657 | 10721 | CCACAGUAGUGGCAACUCC | 12721 | ccAcAGuAGuGGcAAcuccdTsdT | sense |
| 1638-1657 | 10722 | GGAGUUGCCACUACUGUGG | 12722 | GGAGUUGCcACuACUGUGGdTsdT | antis |
| 1647-1666 | 10723 | UGGCAACUCCUGGCCAGGG | 12723 | uGGcAAcuccuGGccAGGGdTsdT | sense |
| 1647-1666 | 10724 | CCCUGGCCAGGAGUUGCCA | 12724 | CCCUGGCcAGGAGUUGCcAdTsdT | antis |
| 1657-1676 | 10725 | UGGCCAGGGUCCUGACAGG | 12725 | uGGccAGGGuccuGAcAGGdTsdT | sense |
| 1657-1676 | 10726 | CCUGUCAGGACCCUGGCCA | 12726 | CCUGUcAGGACCCUGGCcAdTsdT | antis |
| 1660-1679 | 10727 | CCAGGGUCCUGACAGGCCA | 12727 | ccAGGGuccuGAcAGGccAdTsdT | sense |
| 1660-1679 | 10728 | UGGCCUGUCAGGACCCUGG | 12728 | UGGCCUGUcAGGACCCUGGdTsdT | antis |
| 1664-1683 | 10729 | GGUCCUGACAGGCCACAGG | 12729 | GGuccuGAcAGGccAcAGGdTsdT | sense |
| 1664-1683 | 10730 | CCUGUGGCCUGUCAGGACC | 12730 | CCUGUGGCCUGUcAGGACCdTsdT | antis |
| 1668-1687 | 10731 | CUGACAGGCCACAGGAAGU | 12731 | cuGAcAGGccAcAGGAAGudTsdT | sense |
| 1668-1687 | 10732 | ACUUCCUGUGGCCUGUCAG | 12732 | ACUUCCUGUGGCCUGUcAGdTsdT | antis |
| 1692-1711 | 10733 | AUACAGACACGAAAGUGAU | 12733 | AuAcAGAcAcGAAAGuGAudTsdT | sense |
| 1692-1711 | 10734 | AUCACUUUCGUGUCUGUAU | 12734 | AUcACUUUCGUGUCUGuAUdTsdT | antis |
| 1694-1713 | 10735 | ACAGACACGAAAGUGAUUG | 12735 | AcAGAcAcGAAAGuGAuuGdTsdT | sense |
| 1694-1713 | 10736 | CAAUCACUUUCGUGUCUGU | 12736 | cAAUcACUUUCGUGUCUGUdTsdT | antis |
| 1716-1735 | 10737 | AUGGAUCAUUUGGUGUGGU | 12737 | AuGGAucAuuuGGuGuGGudTsdT | sense |
| 1716-1735 | 10738 | ACCACACCAAAUGAUCCAU | 12738 | ACcAcACcAAAUGAUCcAUdTsdT | antis |
| 1730-1749 | 10739 | GUGGUAUAUCAAGCCAAAC | 12739 | GuGGuAuAucAAGccAAAcdTsdT | sense |
| 1730-1749 | 10740 | GUUUGGCUUGAUAUACCAC | 12740 | GUUUGGCUUGAuAuACcACdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1764-1783 | 10741 | AACUGGUUGCCAUCAAGAA | 12741 | AAcuGGuuGccAucAAGAAdTsdT | sense |
| 1764-1783 | 10742 | UUCUUGAUGGCAACCAGUU | 12742 | UUCUUGAUGGcAACcAGUUdTsdT | antis |
| 1765-1784 | 10743 | ACUGGUUGCCAUCAAGAAA | 12743 | AcuGGuuGccAucAAGAAAdTsdT | sense |
| 1765-1784 | 10744 | UUUCUUGAUGGCAACCAGU | 12744 | UUUCUUGAUGGcAACcAGUdTsdT | antis |
| 1766-1785 | 10745 | CUGGUUGCCAUCAAGAAAG | 12745 | cuGGuuGccAucAAGAAAGdTsdT | sense |
| 1766-1785 | 10746 | CUUUCUUGAUGGCAACCAG | 12746 | CUUUCUUGAUGGcAACcAGdTsdT | antis |
| 1771-1790 | 10747 | UGCCAUCAAGAAAGUUCUA | 12747 | uGccAucAAGAAAGuucuAdTsdT | sense |
| 1771-1790 | 10748 | UAGAACUUUCUUGAUGGCA | 12748 | uAGAACUUUCUUGAUGGcAdTsdT | antis |
| 1777-1796 | 10749 | CAAGAAAGUUCUACAGGAC | 12749 | cAAGAAAGuucuAcAGGAcdTsdT | sense |
| 1777-1796 | 10750 | GUCCUGUAGAACUUUCUUG | 12750 | GUCCUGuAGAACUUUCUUGdTsdT | antis |
| 1811-1830 | 10751 | CGAGAGCUCCAGAUCAUGA | 12751 | cGAGAGcuccAGAucAuGAdTsdT | sense |
| 1811-1830 | 10752 | UCAUGAUCUGGAGCUCUCG | 12752 | UcAUGAUCUGGAGCUCUCGdTsdT | antis |
| 1814-1833 | 10753 | GAGCUCCAGAUCAUGAGAA | 12753 | GAGcuccAGAucAuGAGAAdTsdT | sense |
| 1814-1833 | 10754 | UUCUCAUGAUCUGGAGCUC | 12754 | UUCUcAUGAUCUGGAGCUCdTsdT | antis |
| 1835-1854 | 10755 | CUAGACCACUGUAACAUAG | 12755 | cuAGAccAcuGuAAcAuAGdTsdT | sense |
| 1835-1854 | 10756 | CUAUGUUACAGUGGUCUAG | 12756 | CuAUGUuAcAGUGGUCuAGdTsdT | antis |
| 1881-1900 | 10757 | GUGGUGAGAAGAAAGAUGA | 12757 | GuGGuGAGAAGAAAGAuGAdTsdT | sense |
| 1881-1900 | 10758 | UCAUCUUUCUUCUCACCAC | 12758 | UcAUCUUUCUUCUcACcACdTsdT | antis |
| 1882-1901 | 10759 | UGGUGAGAAGAAAGAUGAG | 12759 | uGGuGAGAAGAAAGAuGAGdTsdT | sense |
| 1882-1901 | 10760 | CUCAUCUUUCUUCUCACCA | 12760 | CUcAUCUUUCUUCUcACcAdTsdT | antis |
| 1902-1921 | 10761 | UCUACCUUAACCUGGUGCU | 12761 | ucuAccuuAAccuGGuGcudTsdT | sense |
| 1902-1921 | 10762 | AGCACCAGGUUAAGGUAGA | 12762 | AGcACcAGGUuAAGGuAGAdTsdT | antis |
| 1914-1933 | 10763 | UGGUGCUGGACUAUGUUCC | 12763 | uGGuGcuGGAcuAuGuuccdTsdT | sense |
| 1914-1933 | 10764 | GGAACAUAGUCCAGCACCA | 12764 | GGAAcAuAGUCcAGcACcAdTsdT | antis |
| 1932-1951 | 10765 | CGGAGACAGUGUACAGAGU | 12765 | cGGAGAcAGuGuAcAGAGudTsdT | sense |
| 1932-1951 | 10766 | ACUCUGUACACUGUCUCCG | 12766 | ACUCUGuAcACUGUCUCCGdTsdT | antis |
| 1968-1987 | 10767 | GAGCCAAGCAGACACUCCC | 12767 | GAGccAAGcAGAcAcucccdTsdT | sense |
| 1968-1987 | 10768 | GGGAGUGUCUGCUUGGCUC | 12768 | GGGAGUGUCUGCUUGGCUCdTsdT | antis |
| 1969-1988 | 10769 | AGCCAAGCAGACACUCCCU | 12769 | AGccAAGcAGAcAcucccudTsdT | sense |
| 1969-1988 | 10770 | AGGGAGUGUCUGCUUGGCU | 12770 | AGGGAGUGUCUGCUUGGCUdTsdT | antis |
| 1976-1995 | 10771 | CAGACACUCCCUGUGAUCU | 12771 | cAGAcAcucccuGuGAucudTsdT | sense |
| 1976-1995 | 10772 | AGAUCACAGGGAGUGUCUG | 12772 | AGAUcAcAGGGAGUGUCUGdTsdT | antis |
| 2002-2021 | 10773 | GUUGUAUAUGUAUCAGCUG | 12773 | GuuGuAuAuGuAucAGcuGdTsdT | sense |
| 2002-2021 | 10774 | CAGCUGAUACAUAUACAAC | 12774 | cAGCUGAuAcAuAuAcAACdTsdT | antis |
| 2013-2032 | 10775 | AUCAGCUGUUCAGAAGUCU | 12775 | AucAGcuGuucAGAAGucudTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2013-2032 | 10776 | AGACUUCUGAACAGCUGAU | 12776 | AGACUUCUGAAcAGCUGAUdTsdT | antis |
| 2014-2033 | 10777 | UCAGCUGUUCAGAAGUCUA | 12777 | ucAGcuGuucAGAAGucuAdTsdT | sense |
| 2014-2033 | 10778 | UAGACUUCUGAACAGCUGA | 12778 | uAGACUUCUGAAcAGCUGAdTsdT | antis |
| 2032-2051 | 10779 | AGCCUAUAUCCAUUCCUUU | 12779 | AGccuAuAuccAuuccuuudTsdT | sense |
| 2032-2051 | 10780 | AAAGGAAUGGAUAUAGGCU | 12780 | AAAGGAAUGGAuAuAGGCUdTsdT | antis |
| 2033-2052 | 10781 | GCCUAUAUCCAUUCCUUUG | 12781 | GccuAuAuccAuuccuuuGdTsdT | sense |
| 2033-2052 | 10782 | CAAAGGAAUGGAUAUAGGC | 12782 | cAAAGGAAUGGAuAuAGGCdTsdT | antis |
| 2034-2053 | 10783 | CCUAUAUCCAUUCCUUUGG | 12783 | ccuAuAuccAuuccuuuGGdTsdT | sense |
| 2034-2053 | 10784 | CCAAAGGAAUGGAUAUAGG | 12784 | CcAAAGGAAUGGAuAuAGGdTsdT | antis |
| 2037-2056 | 10785 | AUAUCCAUUCCUUUGGAAU | 12785 | AuAuccAuuccuuuGGAAudTsdT | sense |
| 2037-2056 | 10786 | AUUCCAAAGGAAUGGAUAU | 12786 | AUUCcAAAGGAAUGGAuAUdTsdT | antis |
| 2038-2057 | 10787 | UAUCCAUUCCUUUGGAAUC | 12787 | uAuccAuuccuuuGGAAucdTsdT | sense |
| 2038-2057 | 10788 | GAUUCCAAAGGAAUGGAUA | 12788 | GAUUCcAAAGGAAUGGAuAdTsdT | antis |
| 2041-2060 | 10789 | CCAUUCCUUUGGAAUCUGC | 12789 | ccAuuccuuuGGAAucuGcdTsdT | sense |
| 2041-2060 | 10790 | GCAGAUUCCAAAGGAAUGG | 12790 | GcAGAUUCcAAAGGAAUGGdTsdT | antis |
| 2045-2064 | 10791 | UCCUUUGGAAUCUGCCAUC | 12791 | uccuuuGGAAucuGccAucdTsdT | sense |
| 2045-2064 | 10792 | GAUGGCAGAUUCCAAAGGA | 12792 | GAUGGcAGAUUCcAAAGGAdTsdT | antis |
| 2069-2088 | 10793 | AUUAAACCACAGAACCUCU | 12793 | AuuAAAccAcAGAAccucudTsdT | sense |
| 2069-2088 | 10794 | AGAGGUUCUGUGGUUUAAU | 12794 | AGAGGUUCUGUGGUUuAAUdTsdT | antis |
| 2110-2129 | 10795 | AUUAAAACUCUGUGACUUU | 12795 | AuuAAAAcucuGuGAcuuudTsdT | sense |
| 2110-2129 | 10796 | AAAGUCACAGAGUUUUAAU | 12796 | AAAGUcAcAGAGUUUuAAUdTsdT | antis |
| 2111-2130 | 10797 | UUAAAACUCUGUGACUUUG | 12797 | uuAAAAcucuGuGAcuuuGdTsdT | sense |
| 2111-2130 | 10798 | CAAAGUCACAGAGUUUUAA | 12798 | cAAAGUcAcAGAGUUUuAAdTsdT | antis |
| 2114-2133 | 10799 | AAACUCUGUGACUUUGGAA | 12799 | AAAcucuGuGAcuuuGGAAdTsdT | sense |
| 2114-2133 | 10800 | UUCCAAAGUCACAGAGUUU | 12800 | UUCcAAAGUcAcAGAGUUUdTsdT | antis |
| 2121-2140 | 10801 | GUGACUUUGGAAGUGCAAA | 12801 | GuGAcuuuGGAAGuGcAAAdTsdT | sense |
| 2121-2140 | 10802 | UUUGCACUUCCAAAGUCAC | 12802 | UUUGcACUUCcAAAGUcACdTsdT | antis |
| 2122-2141 | 10803 | UGACUUUGGAAGUGCAAAG | 12803 | uGAcuuuGGAAGuGcAAAGdTsdT | sense |
| 2122-2141 | 10804 | CUUUGCACUUCCAAAGUCA | 12804 | CUUUGcACUUCcAAAGUcAdTsdT | antis |
| 2127-2146 | 10805 | UUGGAAGUGCAAAGCAGCU | 12805 | uuGGAAGuGcAAAGcAGcudTsdT | sense |
| 2127-2146 | 10806 | AGCUGCUUUGCACUUCCAA | 12806 | AGCUGCUUUGcACUUCcAAdTsdT | antis |
| 2128-2147 | 10807 | UGGAAGUGCAAAGCAGCUG | 12807 | uGGAAGuGcAAAGcAGcuGdTsdT | sense |
| 2128-2147 | 10808 | CAGCUGCUUUGCACUUCCA | 12808 | cAGCUGCUUUGcACUUCcAdTsdT | antis |
| 2130-2149 | 10809 | GAAGUGCAAAGCAGCUGGU | 12809 | GAAGuGcAAAGcAGcuGGudTsdT | sense |
| 2130-2149 | 10810 | ACCAGCUGCUUUGCACUUC | 12810 | ACcAGCUGCUUUGcACUUCdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2144-2163 | 10811 | CUGGUCCGAGGAGAGCCCA | 12811 | cuGGuccGAGGAGAGcccAdTsdT | sense |
| 2144-2163 | 10812 | UGGGCUCUCCUCGGACCAG | 12812 | UGGGCUCUCCUCGGACcAGdTsdT | antis |
| 2145-2164 | 10813 | UGGUCCGAGGAGAGCCCAA | 12813 | uGGuccGAGGAGAGcccAAdTsdT | sense |
| 2145-2164 | 10814 | UUGGGCUCUCCUCGGACCA | 12814 | UUGGGCUCUCCUCGGACcAdTsdT | antis |
| 2152-2171 | 10815 | AGGAGAGCCCAAUGUUUCA | 12815 | AGGAGAGcccAAuGuuucAdTsdT | sense |
| 2152-2171 | 10816 | UGAAACAUUGGGCUCUCCU | 12816 | UGAAAcAUUGGGCUCUCCUdTsdT | antis |
| 2173-2192 | 10817 | UAUCUGUUCUCGGUACUAC | 12817 | uAucuGuucucGGuAcuAcdTsdT | sense |
| 2173-2192 | 10818 | GUAGUACCGAGAACAGAUA | 12818 | GuAGuACCGAGAAcAGAuAdTsdT | antis |
| 2244-2263 | 10819 | UAUGGUCUGCAGGCUGUGU | 12819 | uAuGGucuGcAGGcuGuGudTsdT | sense |
| 2244-2263 | 10820 | ACACAGCCUGCAGACCAUA | 12820 | AcAcAGCCUGcAGACcAuAdTsdT | antis |
| 2293-2312 | 10821 | AUUUCCUGGGGACAGUGGU | 12821 | AuuuccuGGGGAcAGuGGudTsdT | sense |
| 2293-2312 | 10822 | ACCACUGUCCCCAGGAAAU | 12822 | ACcACUGUCCcAGGAAAUdTsdT | antis |
| 2296-2315 | 10823 | UCCUGGGGACAGUGGUGUG | 12823 | uccuGGGGAcAGuGGuGuGdTsdT | sense |
| 2296-2315 | 10824 | CACACCACUGUCCCCAGGA | 12824 | cAcAccACUGUCCCcAGGAdTsdT | antis |
| 2297-2316 | 10825 | CCUGGGGACAGUGGUGUGG | 12825 | ccuGGGGAcAGuGGuGuGGdTsdT | sense |
| 2297-2316 | 10826 | CCACACCACUGUCCCCAGG | 12826 | CcAcAccACUGUCCCcAGGdTsdT | antis |
| 2320-2339 | 10827 | GUUGGUGGAAAUAAUAAAG | 12827 | GuuGGuGGAAAuAAuAAAGdTsdT | sense |
| 2320-2339 | 10828 | CUUUAUUAUUUCCACCAAC | 12828 | CUUuAUuAUUUCcACcAACdTsdT | antis |
| 2321-2340 | 10829 | UUGGUGGAAAUAAUAAAGG | 12829 | uuGGuGGAAAuAAuAAAGGdTsdT | sense |
| 2321-2340 | 10830 | CCUUUAUUAUUUCCACCAA | 12830 | CCUUuAUuAUUUCcACcAAdTsdT | antis |
| 2322-2341 | 10831 | UGGUGGAAAUAAUAAAGGU | 12831 | uGGuGGAAAuAAuAAAGGUdTsdT | sense |
| 2322-2341 | 10832 | ACCUUUAUUAUUUCCACCA | 12832 | ACCUUuAUuAUUUCcACcAdTsdT | antis |
| 2348-2367 | 10833 | ACACCAACAAGGGAGCAAA | 12833 | AcAccAAcAAGGGAGcAAAdTsdT | sense |
| 2348-2367 | 10834 | UUUGCUCCCUUGUUGGUGU | 12834 | UUUGCUCCCUUGUUGGUGUdTsdT | antis |
| 2349-2368 | 10835 | CACCAACAAGGGAGCAAAU | 12835 | cAccAAcAAGGGAGcAAAUdTsdT | sense |
| 2349-2368 | 10836 | AUUUGCUCCCUUGUUGGUG | 12836 | AUUUGCUCCCUUGUUGGUGdTsdT | antis |
| 2389-2408 | 10837 | UACAGAAUUCAAAUUCCCU | 12837 | uAcAGAAuucAAAuucccudTsdT | sense |
| 2389-2408 | 10838 | AGGGAAUUUGAAUUCUGUA | 12838 | AGGGAAUUUGAAUUCUGuAdTsdT | antis |
| 2414-2433 | 10839 | AAGGCACAUCCUUGGACAA | 12839 | AAGGcAcAuccuuGGAcAAdTsdT | sense |
| 2414-2433 | 10840 | UUGUCCAAGGAUGUGCCUU | 12840 | UUGUCcAAGGAUGUGCCUUdTsdT | antis |
| 2419-2438 | 10841 | ACAUCCUUGGACAAAGGUC | 12841 | AcAuccuuGGAcAAAGGucdTsdT | sense |
| 2419-2438 | 10842 | GACCUUUGUCCAAGGAUGU | 12842 | GACCUUUGUCcAAGGAUGUdTsdT | antis |
| 2429-2448 | 10843 | ACAAAGGUCUUCCGGCCCC | 12843 | AcAAAGGucuuccGGccccdTsdT | sense |
| 2429-2448 | 10844 | GGGGCCGGAAGACCUUUGU | 12844 | GGGGCCGGAAGACCUUUGUdTsdT | antis |
| 2460-2479 | 10845 | AGGCAAUUGCACUGUGCAG | 12845 | AGGcAAuuGcAcuGuGcAGdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2460-2479 | 10846 | CUGCACAGUGCAAUUGCCU | 12846 | CUGcAcAGUGcAAUUGCCUdTsdT | antis |
| 2474-2493 | 10847 | UGCAGCCGUCUGCUGGAGU | 12847 | uGcAGccGucuGcuGGAGudTsdT | sense |
| 2474-2493 | 10848 | ACUCCAGCAGACGGCUGCA | 12848 | ACUCcAGcAGACGGCUGcAdTsdT | antis |
| 2480-2499 | 10849 | CGUCUGCUGGAGUACACAC | 12849 | cGucuGcuGGAGuAcAcAcdTsdT | sense |
| 2480-2499 | 10850 | GUGUGUACUCCAGCAGACG | 12850 | GUGUGuACUCcAGcAGACGdTsdT | antis |
| 2481-2500 | 10851 | GUCUGCUGGAGUACACACC | 12851 | GucuGcuGGAGuAcAcAccdTsdT | sense |
| 2481-2500 | 10852 | GGUGUGUACUCCAGCAGAC | 12852 | GGUGUGuACUCcAGcAGACdTsdT | antis |
| 2511-2530 | 10853 | UAACACCACUGGAAGCUUG | 12853 | uAAcAccAcuGGAAGcuuGdTsdT | sense |
| 2511-2530 | 10854 | CAAGCUUCCAGUGGUGUUA | 12854 | cAAGCUUCcAGUGGUGUuAdTsdT | antis |
| 1540-1559 | 10855 | GAGAACCACCUCCUUUGCG | 12855 | GAGAAccAccuccuuuGcGdTsdT | sense |
| 1540-1559 | 10856 | CGCAAAGGAGGUGGUUCUC | 12856 | CGcAAAGGAGGUGGUUCUCdTsdT | antis |
| 1883-1902 | 10857 | GGUGAGAAGAAAGAUGAGG | 12857 | GGuGAGAAGAAAGAuGAGGdTsdT | sense |
| 1883-1902 | 10858 | CCUCAUCUUUCUUCUCACC | 12858 | CCUcAUCUUUCUUCUcACCdTsdT | antis |
| 2044-2063 | 10859 | UUCCUUUGGAAUCUGCCAU | 12859 | uuccuuuGGAAucuGccAudTsdT | sense |
| 2044-2063 | 10860 | AUGGCAGAUUCCAAAGGAA | 12860 | AUGGcAGAUUCcAAAGGAAdTsdT | antis |
| 2205-2224 | 10861 | UGAUCUUUGGAGCCACUGA | 12861 | uGAucuuuGGAGccAcuGAdTsdT | sense |
| 2205-2224 | 10862 | UCAGUGGCUCCAAAGAUCA | 12862 | UcAGUGGCUCcAAAGAUcAdTsdT | antis |
| 2331-2350 | 10863 | UAAUAAAGGUCCUAGGAAC | 12863 | uAAuAAAGGuccuAGGAAcdTsdT | sense |
| 2331-2350 | 10864 | GUUCCUAGGACCUUUAUUA | 12864 | GUUCCuAGGACCUUuAUuAdTsdT | antis |
| 2384-2403 | 10865 | AAUUAUACAGAAUUCAAAU | 12865 | AAuuAuAcAGAAuucAAAudTsdT | sense |
| 2384-2403 | 10866 | AUUUGAAUUCUGUAUAAUU | 12866 | AUUUGAAUUCUGuAuAAUUdTsdT | antis |
| 1557-1576 | 10867 | CGGAGAGCUGCAAGCCAGU | 12867 | cGGAGAGcuGcAAGccAGudTsdT | sense |
| 1557-1576 | 10868 | ACUGGCUUGCAGCUCUCCG | 12868 | ACUGGCUUGcAGCUCUCCGdTsdT | antis |
| 1567-1586 | 10869 | CAAGCCAGUGCAGCAGCCU | 12869 | cAAGccAGuGcAGcAGccudTsdT | sense |
| 1567-1586 | 10870 | AGGCUGCUGCACUGGCUUG | 12870 | AGGCUGCUGcACUGGCUUGdTsdT | antis |
| 1568-1587 | 10871 | AAGCCAGUGCAGCAGCCUU | 12871 | AAGccAGuGcAGcAGccuudTsdT | sense |
| 1568-1587 | 10872 | AAGGCUGCUGCACUGGCUU | 12872 | AAGGCUGCUGcACUGGCUUdTsdT | antis |
| 1580-1599 | 10873 | CAGCCUUCAGCUUUUGGUA | 12873 | cAGccuucAGcuuuuGGuAdTsdT | sense |
| 1580-1599 | 10874 | UACCAAAAGCUGAAGGCUG | 12874 | uACcAAAAGCUGAAGGCUGdTsdT | antis |
| 1583-1602 | 10875 | CCUUCAGCUUUUGGUAGCA | 12875 | ccuucAGcuuuuGGuAGcAdTsdT | sense |
| 1583-1602 | 10876 | UGCUACCAAAAGCUGAAGG | 12876 | UGCuAccAAAAGCUGAAGGdTsdT | antis |
| 1590-1609 | 10877 | CUUUUGGUAGCAUGAAAGU | 12877 | cuuuuGGuAGcAuGAAAGudTsdT | sense |
| 1590-1609 | 10878 | ACUUUCAUGCUACCAAAAG | 12878 | ACUUUcAUGCuAccAAAAGdTsdT | antis |
| 1609-1628 | 10879 | UAGCAGAGAUAAAGAUGGC | 12879 | uAGcAGAGAuAAAGAuGGcdTsdT | sense |
| 1609-1628 | 10880 | GCCAUCUUUAUCUCUGCUA | 12880 | GCcAUCUUuAUCUCUGCuAdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 1615-1634 | 10881 | AGAUAAAGAUGGCAGCAAG | 12881 | AGAuAAAGAuGGcAGcAAGdTsdT | sense |
| 1615-1634 | 10882 | CUUGCUGCCAUCUUUAUCU | 12882 | CUUGCUGCcAUCUUuAUCUdTsdT | antis |
| 1655-1674 | 10883 | CCUGGCCAGGGUCCUGACA | 12883 | ccuGGccAGGGuccuGAcAdTsdT | sense |
| 1655-1674 | 10884 | UGUCAGGACCCUGGCCAGG | 12884 | UGUcAGGACCCUGGCcAGGdTsdT | antis |
| 1671-1690 | 10885 | ACAGGCCACAGGAAGUCAG | 12885 | AcAGGccAcAGGAAGucAGdTsdT | sense |
| 1671-1690 | 10886 | CUGACUUCCUGUGGCCUGU | 12886 | CUGACUUCCUGUGGCCUGUdTsdT | antis |
| 1672-1691 | 10887 | CAGGCCACAGGAAGUCAGU | 12887 | cAGGccAcAGGAAGucAGudTsdT | sense |
| 1672-1691 | 10888 | ACUGACUUCCUGUGGCCUG | 12888 | ACUGACUUCCUGUGGCCUGdTsdT | antis |
| 1747-1766 | 10889 | ACUUUGUGAUUCUGGAGAA | 12889 | AcuuuGuGAuucuGGAGAAdTsdT | sense |
| 1747-1766 | 10890 | UUCUCCAGAAUCACAAAGU | 12890 | UUCUCcAGAAUcAcAAAGUdTsdT | antis |
| 1748-1767 | 10891 | CUUUGUGAUUCUGGAGAAC | 12891 | cuuuGuGAuucuGGAGAAcdTsdT | sense |
| 1748-1767 | 10892 | GUUCUCCAGAAUCACAAAG | 12892 | GUUCUCcAGAAUcAcAAAGdTsdT | antis |
| 1750-1769 | 10893 | UUGUGAUUCUGGAGAACUG | 12893 | uuGuGAuucuGGAGAAcuGdTsdT | sense |
| 1750-1769 | 10894 | CAGUUCUCCAGAAUCACAA | 12894 | cAGUUCUCcAGAAUcAcAAdTsdT | antis |
| 1751-1770 | 10895 | UGUGAUUCUGGAGAACUGG | 12895 | uGuGAuucuGGAGAAcuGGdTsdT | sense |
| 1751-1770 | 10896 | CCAGUUCUCCAGAAUCACA | 12896 | CcAGUUCUCcAGAAUcAcAdTsdT | antis |
| 1752-1771 | 10897 | GUGAUUCUGGAGAACUGGU | 12897 | GuGAuucuGGAGAAcuGGudTsdT | sense |
| 1752-1771 | 10898 | ACCAGUUCUCCAGAAUCAC | 12898 | ACcAGUUCUCcAGAAUcACdTsdT | antis |
| 1753-1772 | 10899 | UGAUUCUGGAGAACUGGUU | 12899 | uGAuucuGGAGAAcuGGuudTsdT | sense |
| 1753-1772 | 10900 | AACCAGUUCUCCAGAAUCA | 12900 | AACcAGUUCUCcAGAAUcAdTsdT | antis |
| 2117-2136 | 10901 | CUCUGUGACUUUGGAAGUG | 12901 | cucuGuGAcuuuGGAAGuGdTsdT | sense |
| 2117-2136 | 10902 | CACUUCCAAAGUCACAGAG | 12902 | cACUUCcAAAGUcAcAGAGdTsdT | antis |
| 2118-2137 | 10903 | UCUGUGACUUUGGAAGUGC | 12903 | ucuGuGAcuuuGGAAGuGcdTsdT | sense |
| 2118-2137 | 10904 | GCACUUCCAAAGUCACAGA | 12904 | GcACUUCcAAAGUcAcAGAdTsdT | antis |
| 2148-2167 | 10905 | UCCGAGGAGAGCCCAAUGU | 12905 | uccGAGGAGAGcccAAuGudTsdT | sense |
| 2148-2167 | 10906 | ACAUUGGGCUCUCCUCGGA | 12906 | AcAUUGGGCUCUCCUCGGAdTsdT | antis |
| 2202-2221 | 10907 | AGUUGAUCUUUGGAGCCAC | 12907 | AGuuGAucuuuGGAGccAcdTsdT | sense |
| 2202-2221 | 10908 | GUGGCUCCAAAGAUCAACU | 12908 | GUGGCUCcAAAGAUcAACUdTsdT | antis |
| 2203-2222 | 10909 | GUUGAUCUUUGGAGCCACU | 12909 | GuuGAucuuuGGAGccAcudTsdT | sense |
| 2203-2222 | 10910 | AGUGGCUCCAAAGAUCAAC | 12910 | AGUGGCUCcAAAGAUcAACdTsdT | antis |
| 2204-2223 | 10911 | UUGAUCUUUGGAGCCACUG | 12911 | uuGAucuuuGGAGccAcuGdTsdT | sense |
| 2204-2223 | 10912 | CAGUGGCUCCAAAGAUCAA | 12912 | cAGUGGCUCcAAAGAUcAAdTsdT | antis |
| 2206-2225 | 10913 | GAUCUUUGGAGCCACUGAU | 12913 | GAucuuuGGAGccAcuGAudTsdT | sense |
| 2206-2225 | 10914 | AUCAGUGGCUCCAAAGAUC | 12914 | AUcAGUGGCUCcAAAGAUCdTsdT | antis |
| 2245-2264 | 10915 | AUGGUCUGCAGGCUGUGUG | 12915 | AuGGucuGcAGGcuGuGuGdTsdT | sense |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2245-2264 | 10916 | CACACAGCCUGCAGACCAU | 12916 | cAcAcAGCCUGcAGACcAUdTsdT | antis |
| 2252-2271 | 10917 | GCAGGCUGUGUGUUGGCUG | 12917 | GcAGGcuGuGuGuuGGcuGdTsdT | sense |
| 2252-2271 | 10918 | CAGCCAACACACAGCCUGC | 12918 | cAGCcAAcAcAcAGCCUGCdTsdT | antis |
| 2266-2285 | 10919 | GGCUGAAUUGUUGCUAGGA | 12919 | GGcuGAAuuGuuGcuAGGAdTsdT | sense |
| 2266-2285 | 10920 | UCCUAGCAACAAUUCAGCC | 12920 | UCCuAGcAAcAAUUcAGCCdTsdT | antis |
| 2294-2313 | 10921 | UUUCCUGGGGACAGUGGUG | 12921 | uuuccuGGGGAcAGuGGuGdTsdT | sense |
| 2294-2313 | 10922 | CACCACUGUCCCCAGGAAA | 12922 | cAccACUGUCCCcAGGAAAdTsdT | antis |
| 2295-2314 | 10923 | UUCCUGGGGACAGUGGUGU | 12923 | uuccuGGGGAcAGuGGuGudTsdT | sense |
| 2295-2314 | 10924 | ACACCACUGUCCCCAGGAA | 12924 | AcACcACUGUCCCcAGGAAdTsdT | antis |
| 2350-2369 | 10925 | ACCAACAAGGGAGCAAAUU | 12925 | AccAAcAAGGGAGcAAAuudTsdT | sense |
| 2350-2369 | 10926 | AAUUUGCUCCCUUGUUGGU | 12926 | AAUUUGCUCCCUUGUUGGUdTsdT | antis |
| 2382-2401 | 10927 | CAAAUUAUACAGAAUUCAA | 12927 | cAAAuuAuAcAGAAuucAAdTsdT | sense |
| 2382-2401 | 10928 | UUGAAUUCUGUAUAAUUUG | 12928 | UUGAAUUCUGuAuAAUUUGdTsdT | antis |
| 1543-1562 | 10929 | AACCACCUCCUUUGCGGAG | 12929 | AAccAccuccuuuGcGGAGdTsdT | sense |
| 1543-1562 | 10930 | CUCCGCAAAGGAGGUGGUU | 12930 | CUCCGcAAAGGAGGUGGUUdTsdT | antis |
| 1544-1563 | 10931 | ACCACCUCCUUUGCGGAGA | 12931 | AccAccuccuuuGcGGAGAdTsdT | sense |
| 1544-1563 | 10932 | UCUCCGCAAAGGAGGUGGU | 12932 | UCUCCGcAAAGGAGGUGGUdTsdT | antis |
| 1545-1564 | 10933 | CCACCUCCUUUGCGGAGAG | 12933 | ccAccuccuuuGcGGAGAGdTsdT | sense |
| 1545-1564 | 10934 | CUCUCCGCAAAGGAGGUGG | 12934 | CUCUCCGcAAAGGAGGUGGdTsdT | antis |
| 1712-1731 | 10935 | GGAAAUGGAUCAUUUGGUG | 12935 | GGAAAuGGAucAuuuGGuGdTsdT | sense |
| 1712-1731 | 10936 | CACCAAAUGAUCCAUUUCC | 12936 | cAccAAAUGAUCcAUUUCCdTsdT | antis |
| 1879-1898 | 10937 | GAGUGGUGAGAAGAAAGAU | 12937 | GAGuGGuGAGAAGAAAGAudTsdT | sense |
| 1879-1898 | 10938 | AUCUUUCUUCUCACCACUC | 12938 | AUCUUUCUUCUcAccACUCdTsdT | antis |
| 2060-2079 | 10939 | CAUCGAGACAUUAAACCAC | 12939 | cAucGAGAcAuuAAccAcdTsdT | sense |
| 2060-2079 | 10940 | GUGGUUUAAUGUCUCGAUG | 12940 | GUGGUUuAAUGUCUCGAUGdTsdT | antis |
| 2062-2081 | 10941 | UCGAGACAUUAAACCACAG | 12941 | ucGAGAcAuuAAccAcAGdTsdT | sense |
| 2062-2081 | 10942 | CUGUGGUUUAAUGUCUCGA | 12942 | CUGUGGUUuAAUGUCUCGAdTsdT | antis |
| 2061-2080 | 10943 | AUCGAGACAUUAAACCACA | 12943 | AucGAGAcAuuAAccAcAdTsdT | sense |
| 2061-2080 | 10944 | UGUGGUUUAAUGUCUCGAU | 12944 | UGUGGUUuAAUGUCUCGAUdTsdT | antis |
| 2058-2077 | 10945 | GCCAUCGAGACAUUAAACC | 12945 | GccAucGAGAcAuuAAccdTsdT | sense |
| 2058-2077 | 10946 | GGUUUAAUGUCUCGAUGGC | 12946 | GGUUuAAUGUCUCGAUGGCdTsdT | antis |
| 2059-2078 | 10947 | CCAUCGAGACAUUAAACCA | 12947 | ccAucGAGAcAuuAAccAdTsdT | sense |
| 2059-2078 | 10948 | UGGUUUAAUGUCUCGAUGG | 12948 | UGGUUuAAUGUCUCGAUGGdTsdT | antis |
| 1639-1658 | 10949 | CACAGUAGUGGCAACUCCU | 12949 | cAcAGuAGuGGcAAcuccudTsdT | sense |
| 1639-1658 | 10950 | AGGAGUUGCCACUACUGUG | 12950 | AGGAGUUGCcAcuACUGUGdTsdT | antis |

TABLE 2-continued

Sequences of duplexes targeting Mouse GSK3-beta
Sequences of duplexes targeting mouse GSK3-beta. Target
sequence location identifies target sequence in mouse GSK3-beta
mRNA NM_019827.6. Sense strand is identical to target
sequence. Antisense strand is complementary to target sequence.

| Target sequence location | SEQ ID NO: | Unmodified sequence 5' to 3' | SEQ ID NO: | Modified sequence 5' to 3' | Strand |
|---|---|---|---|---|---|
| 2064-2083 | 10951 | GAGACAUUAAACCACAGAA | 12951 | GAGAcAuuAAAccAcAGAAdTsdT | sense |
| 2064-2083 | 10952 | UUCUGUGGUUUAAUGUCUC | 12952 | UUCUGUGGUUuAAUGUCUCdTsdT | antis |
| 1641-1660 | 10953 | CAGUAGUGGCAACUCCUGG | 12953 | cAGuAGuGGcAAcuccuGGdTsdT | sense |
| 1641-1660 | 10954 | CCAGGAGUUGCCACUACUG | 12954 | CcAGGAGUUGCcACuACUGdTsdT | antis |
| 1812-1831 | 10955 | GAGAGCUCCAGAUCAUGAG | 12955 | GAGAGcuccAGAucAuGAGdTsdT | sense |
| 1812-1831 | 10956 | CUCAUGAUCUGGAGCUCUC | 12956 | CUcAUGAUCUGGAGCUCUCdTsdT | antis |
| 2063-2082 | 10957 | CGAGACAUUAAACCACAGA | 12957 | cGAGAcAuuAAAccAcAGAdTsdT | sense |
| 2063-2082 | 10958 | UCUGUGGUUUAAUGUCUCG | 12958 | UCUGUGGUUuAAUGUCUCGdTsdT | antis |
| 2065-2084 | 10959 | AGACAUUAAACCACAGAAC | 12959 | AGAcAuuAAAccAcAGAAcdTsdT | sense |
| 2065-2084 | 10960 | GUUCUGUGGUUUAAUGUCU | 12960 | GUUCUGUGGUUuAAUGUCUdTsdT | antis |
| 2112-2131 | 10961 | UAAAACUCUGUGACUUUGG | 12961 | uAAAAcucuGuGAcuuuGGdTsdT | sense |
| 2112-2131 | 10962 | CCAAAGUCACAGAGUUUUA | 12962 | CcAAAGUcAcAGAGUUUUAdTsdT | antis |
| 2119-2138 | 10963 | CUGUGACUUUGGAAGUGCA | 12963 | cuGuGAcuuuGGAAGuGcAdTsdT | sense |
| 2119-2138 | 10964 | UGCACUUCCAAAGUCACAG | 12964 | UGcACUUCcAAAGUcAcAGdTsdT | antis |
| 2123-2142 | 10965 | GACUUUGGAAGUGCAAAGC | 12965 | GAcuuuGGAAGuGcAAAGcdTsdT | sense |
| 2123-2142 | 10966 | GCUUUGCACUUCCAAAGUC | 12966 | GCUUUGcACUUCcAAAGUCdTsdT | antis |
| 2131-2150 | 10967 | AAGUGCAAAGCAGCUGGUC | 12967 | AAGuGcAAAGcAGcuGGucdTsdT | sense |
| 2131-2150 | 10968 | GACCAGCUGCUUUGCACUU | 12968 | GACcAGCUGCUUUGcACUUdTsdT | antis |
| 1715-1734 | 10969 | AAUGGAUCAUUUGGUGUGG | 12969 | AAuGGAucAuuuGGuGuGGdTsdT | sense |
| 1715-1734 | 10970 | CCACACCAAAUGAUCCAUU | 12970 | CcAcACcAAAUGAUCcAUUdTsdT | antis |
| 2482-2501 | 10971 | UCUGCUGGAGUACACACCU | 12971 | ucuGcuGGAGuAcAcAccudTsdT | sense |
| 2482-2501 | 10972 | AGGUGUGUACUCCAGCAGA | 12972 | AGGUGUGuACUCcAGcAGAdTsdT | antis |
| 1714-1733 | 10973 | AAAUGGAUCAUUUGGUGUG | 12973 | AAAuGGAucAuuuGGuGuGdTsdT | sense |
| 1714-1733 | 10974 | CACACCAAAUGAUCCAUUU | 12974 | cAcACcAAAUGAUCcAUUUdTsdT | antis |
| 1884-1903 | 10975 | GUGAGAAGAAAGAUGAGGU | 12975 | GuGAGAAGAAAGAuGAGGudTsdT | sense |
| 1884-1903 | 10976 | ACCUCAUCUUUCUUCUCAC | 12976 | ACCUcAUCUUUCUUCUcACdTsdT | antis |
| 2039-2058 | 10977 | AUCCAUUCCUUUGGAAUCU | 12977 | AuccAuuccuuuGGAAucudTsdT | sense |
| 2039-2058 | 10978 | AGAUUCCAAAGGAAUGGAU | 12978 | AGAUUCcAAAGGAAUGGAUdTsdT | antis |
| 2113-2132 | 10979 | AAAACUCUGUGACUUUGGA | 12979 | AAAAcucuGuGAcuuuGGAdTsdT | sense |
| 2113-2132 | 10980 | UCCAAAGUCACAGAGUUUU | 12980 | UCcAAAGUcAcAGAGUUUUdTsdT | antis |
| 2246-2265 | 10981 | UGGUCUGCAGGCUGUGUGU | 12981 | uGGucuGcAGGcuGuGuGudTsdT | sense |
| 2246-2265 | 10982 | ACACACAGCCUGCAGACCA | 12982 | AcAcAcAGCCUGcAGACcAdTsdT | antis |
| 1713-1732 | 10983 | GAAAUGGAUCAUUUGGUGU | 12983 | GAAAuGGAucAuuuGGuGudTsdT | sense |
| 1713-1732 | 10984 | ACACCAAAUGAUCCAUUUC | 12984 | AcACcAAAUGAUCcAUUUCdTsdT | antis |

TABLE 4

Sequences of duplexes targeting Mouse GSK3-alpha
Target sequence start identifies first nucleotide in target sequence in mouse
GSK3-alpha mRNA NM_001031667.1. Unmodified sense strand is identical to target
sequence. Unmodified antisense strand is complementary to target sequence.

| Duplex | Target sequence start | SEQ ID NO: | unmodified sense strand 5' to 3' | SEQ ID NO: | unmodified antisense strand 5' to 3' |
|---|---|---|---|---|---|
| AD-18821 | 670 | 12985 | AACUGCAGAUUAUGCGUAA | 12996 | UUACGCAUAAUCUGCAGUU |
| AD-18823 | 330 | 12986 | GGCGGCGGGAAAGCGUCAG | 12997 | CUGACGCUUUCCCGCCGCC |
| AD-18824 | 239 | 12987 | GGCGCGGACCAGCUCGUUC | 12998 | GAACGAGCUGGUCCGCGCC |
| AD-18825 | 1340 | 12988 | CCUACUGGAGUACACGCCA | 12999 | UGGCGUGUACUCCAGUAGG |
| AD-18826 | 1342 | 12989 | UACUGGAGUACACGCCAUC | 13000 | GAUGGCGUGUACUCCAGUA |
| AD-18827 | 1073 | 12990 | CACAGAUUACACCUCGUCC | 13001 | GGACGAGGUGUAAUCUGUG |
| AD-18828 | 1236 | 12991 | CCUACUAUACGGAGUUCA | 13002 | UGAACUCCGUAUAGUUAGG |
| AD-18829 | 435 | 12992 | GCGGGCACUAGCUUCCCGC | 13003 | GCGGGAAGCUAGUGCCCGC |
| AD-18830 | 1231 | 12993 | UGAACCCUAACUAUACGGA | 13004 | UCCGUAUAGUUAGGGUUCA |
| AD-18831 | 1234 | 12994 | ACCCUAACUAUACGGAGUU | 13005 | AACUCCGUAUAGUUAGGGU |
| AD-18832 | 1235 | 12995 | CCCUAACUAUACGGAGUUC | 13006 | GAACUCCGUAUAGUUAGGG |

| Duplex | Target sequence start | SEQ ID NO: | modified sense strand 5' to 3' | SEQ ID NO: | modified antisense strand 5' to 3' |
|---|---|---|---|---|---|
| AD-18821-b1 | 670 | 13007 | AAcuGcAGAuuAuGcGuAAdTsdT | 13018 | UuACGcAuAAUCUGcAGUUdTsdT |
| AD-18823-b1 | 330 | 13008 | GGcGGcGGGAAAGcGucAGdTsdT | 13019 | CUGACGCUUUCCCGCCGCCdTsdT |
| AD-18824-b1 | 239 | 13009 | GGcGcGGAccAGcucGuucdTsdT | 13020 | GAACGAGCUGGUCCGCGCCdTsdT |
| AD-18825-b1 | 1340 | 13010 | ccuAcuGGAGuAcAcGccAdTsdT | 13021 | UGGCGUGuACUCcAGuAGGdTsdT |
| AD-18826-b1 | 1342 | 13011 | uAcuGGAGuAcAcGccAucdTsdT | 13022 | GAUGGCGUGuACUCcAGuAdTsdT |
| AD-18827-b1 | 1073 | 13012 | cAcAGAuuAcAccucGuccdTsdT | 13023 | GGACGAGGUGuAAUCUGUGdTsdT |
| AD-18828-b1 | 1236 | 13013 | ccuAAcuAuAcGGAGuucAdTsdT | 13024 | UGAACUCCGuAuAGUuAGGdTsdT |
| AD-18829-b1 | 435 | 13014 | GcGGGcAcuAGcuucccGcdTsdT | 13025 | GCGGGAAGCuAGUGCCCGCdTsdT |
| AD-18830-b1 | 1231 | 13015 | uGAAcccuAAcuAuAcGGAdTsdT | 13026 | UCCGuAuAGUuAGGGUUcAdTsdT |
| AD-18831-b1 | 1234 | 13016 | AcccuAAcuAuAcGGAGuudTsdT | 13027 | AACUCCGuAuAGUuAGGGUdTsdT |
| AD-18832-b1 | 1235 | 13017 | cccuAAcuAuAcGGAGuucdTsdT | 13028 | GAACUCCGuAuAGUuAGGGdTsdT |

TABLE 5

Sequences of duplexes targeting Mouse GSK3-beta
Target sequence start identifies first nucleotide in target sequence in mouse
GSK3-beta mRNA NM_019827.6. Unmodified sense strand is identical to target sequence.
Unmodified antisense strand is complementary to target sequence.

| Duplex | Target sequence start | SEQ ID NO: | unmodified sense strand 5' to 3' | SEQ ID NO: | unmodified antisense strand 5' to 3' |
|---|---|---|---|---|---|
| AD-18833 | 1842 | 13029 | ACUGUAACAUAGUCCGACU | 13040 | AGUCGGACUAUGUUACAGU |
| AD-18834 | 1843 | 13030 | CUGUAACAUAGUCCGACUG | 13041 | CAGUCGGACUAUGUUACAG |
| AD-18835 | 1952 | 13031 | GCCAGACACUAUAGUCGAG | 13042 | CUCGACUAUAGUGUCUGGC |
| AD-18836 | 1847 | 13032 | AACAUAGUCCGACUGCGGU | 13043 | ACCGCAGUCGGACUAUGUU |
| AD-18837 | 1838 | 13033 | GACCACUGUAACAUAGUCC | 13044 | GGACUAUGUUACAGUGGUC |

TABLE 5-continued

Sequences of duplexes targeting Mouse GSK3-beta
Target sequence start identifies first nucleotide in target sequence in mouse
GSK3-beta mRNA NM_019827.6. Unmodified sense strand is identical to target sequence.
Unmodified antisense strand is complementary to target sequence.

| Duplex | Target sequence start | SEQ ID NO: | unmodified sense strand 5' to 3' | SEQ ID NO: | unmodified antisense strand 5' to 3' |
|---|---|---|---|---|---|
| AD-18838 | 1846 | 13034 | UAACAUAGUCCGACUGCGG | 13045 | CCGCAGUCGGACUAUGUUA |
| AD-18839 | 1849 | 13035 | CAUAGUCCGACUGCGGUAU | 13046 | AUACCGCAGUCGGACUAUG |
| AD-18841 | 1957 | 13036 | ACACUAUAGUCGAGCCAAG | 13047 | CUUGGCUCGACUAUAGUGU |
| AD-18842 | 2169 | 13037 | CAUAUAUCUGUUCUCGGUA | 13048 | UACCGAGAACAGAUAUAUG |
| AD-18843 | 1788 | 13038 | UACAGGACAAGCGAUUUAA | 13049 | UUAAAUCGCUUGUCCUGUA |
| AD-18844 | 1862 | 13039 | ACUGUAACAUAGUCCGACU | 13050 | UCGAGUAGAAGAAAUACCG |

| Duplex | Target sequence start | SEQ ID NO: | modified sense strand 5' to 3' | SEQ ID NO: | modified antisense strand 5' to 3' |
|---|---|---|---|---|---|
| AD-18833-b1 | 1842 | 13051 | AcuGuAAcAuAGuccGAcudTsdT | 13062 | AGUCGGACuAUGUuAcAGUdTsdT |
| AD-18834-b1 | 1843 | 13052 | cuGuAAcAuAGuccGAcuGdTsdT | 13063 | cAGUCGGACuAUGUuAcAGdTsdT |
| AD-18835-b1 | 1952 | 13053 | GccAGAcAcuAuAGucGAGdTsdT | 13064 | CUCGACuAuAGUGUCUGGCdTsdT |
| AD-18836-b1 | 1847 | 13054 | AAcAuAGuccGAcuGcGGudTsdT | 13065 | ACCGcAGUCGGACuAUGUUdTsdT |
| AD-18837-b1 | 1838 | 13055 | GAccAcuGuAAcAuAGuccdTsdT | 13066 | GGACuAUGUuAcAGUGGUCdTsdT |
| AD-18838-b1 | 1846 | 13056 | uAAcAuAGuccGAcuGcGGdTsdT | 13067 | CCGcAGUCGGACuAUGUuAdTsdT |
| AD-18839-b1 | 1849 | 13057 | cAuAGuccGAcuGcGGuAudTsdT | 13068 | AuACCGcAGUCGGACuAUGdTsdT |
| AD-18841-b1 | 1957 | 13058 | AcAcuAuAGucGAGccAAGdTsdT | 13069 | CUUGGCUCGACuAuAGUGUdTsdT |
| AD-18842-b1 | 2169 | 13059 | cAuAuAucuGuucucGGuAdTsdT | 13070 | uACCGAGAAcAGAuAuAUGdTsdT |
| AD-18843-b1 | 1788 | 13060 | uAcAGGAcAAGcGAuuuAAdTsdT | 13071 | UuAAAUCGCUUGUCCUGuAdTsdT |
| AD-18844-b1 | 1862 | 13061 | cGGuAuuucuucuAcucGAdTsdT | 13072 | UCGAGuAGAAGAAAuACCGdTsdT |

TABLE 6

Sequences of duplexes targeting Human GSK3-alpha
Target sequence start identifies first nucleotide in target sequence in human
GSK3-alpha mRNA NM_002093. Unmodified sense strand is identical to target
sequence. Unmodified antisense strand is complementary to target sequence.

| Duplex | Target sequence start | SEQ ID NO: | unmodified sense strand 5' to 3' | SEQ ID NO: | unmodified antisense strand 5' to 3' |
|---|---|---|---|---|---|
| huGSKA-1 | 1273 | 13073 | AGCUCCAGAUCAUGAGAAA | 13081 | UUUCUCAUGAUCUGGAGCU |
| huGSKA-2 | 1979 | 13074 | UCUGCUGGAGUAUACACCA | 13082 | UGGUGUAUACUCCAGCAGA |
| huGSKA-3 | 1981 | 13075 | UGCUGGAGUAUACACCAAC | 13083 | GUUGGUGUAUACUCCAGCA |
| huGSKA-4 | 1676 | 13076 | CACUGAUUAUACCUCUAGU | 13084 | ACUAGAGGUAUAAUCAGUG |
| huGSKA-5 | 1839 | 13077 | CCAAACUACACAGAAUUUA | 13085 | UAAAUUCUGUGUAGUUUGG |
| huGSKA-6 | 1834 | 13078 | UGAACCCAAACUACACAGA | 13086 | UCUGUGUAGUUUGGGUUCA |
| huGSKA-7 | 1837 | 13079 | ACCCAAACUACACAGAAUU | 13087 | AAUUCUGUGUAGUUUGGGU |
| huGSKA-8 | 1838 | 13080 | CCCAAACUACACAGAAUUU | 13088 | AAAUUCUGUGUAGUUUGGG |

TABLE 6-continued

Sequences of duplexes targeting Human GSK3-alpha
Target sequence start identifies first nucleotide in target sequence in human
GSK3-alpha mRNA NM_002093. Unmodified sense strand is identical to target
sequence. Unmodified antisense strand is complementary to target sequence.

Human GSK alpha duplexes correspond to the mouse GSK alpha duplexes as follows:

| Mouse duplex | Human duplex |
| --- | --- |
| AD-18821 | huGSKA-1 |
| AD-18825 | huGSKA-2 |
| AD-18826 | huGSKA-3 |
| AD-18827 | huGSKA-4 |
| AD-18828 | huGSKA-5 |
| AD-18830 | huGSKA-6 |
| AD-18831 | huGSKA-7 |
| AD-18832 | huGSKA-8 |

TABLE 7

Sequences of duplexes targeting Human GSK3-beta
Target sequence start identifies first nucleotide in target sequence in human
GSK3-beta mRNA NM_019884. Unmodified sense strand is identical to target
sequence. Unmodified antisense strand is complementary to target sequence.

| Duplex | Target sequence start | SEQ ID NO: | unmodified sense strand 5' to 3' | SEQ ID NO: | unmodified antisense strand 5' to 3' |
| --- | --- | --- | --- | --- | --- |
| huGSKB-1 | 625 | 13088 | ACUGCAAUAUUGUGAGGCU | 13099 | AGCCUCACAAUAUUGCAGU |
| huGSKB-2 | 626 | 13089 | CUGCAAUAUUGUGAGGCUG | 13100 | CAGCCUCACAAUAUUGCAG |
| huGSKB-3 | 735 | 13090 | GCCCGCCACUUCACCAAGG | 13101 | CCUUGGUGAAGUGGCGGGC |
| huGSKB-4 | 630 | 13091 | AAUAUUGUGAGGCUGAGAU | 13102 | AUCUCAGCCUCACAAUAUU |
| huGSKB-5 | 621 | 13092 | GACCACUGCAAUAUUGUGA | 13103 | UCACAAUAUUGCAGUGGUC |
| huGSKB-6 | 629 | 13093 | CAAUAUUGUGAGGCUGAGA | 13104 | UCUCAGCCUCACAAUAUUG |
| huGSKB-7 | 632 | 13094 | UAUUGUGAGGCUGAGAUAC | 13105 | GUAUCUCAGCCUCACAAUA |
| huGSKB-8 | 740 | 13095 | CCACUUCACCAAGGCCAAG | 13106 | CUUGGCCUUGGUGAAGUGG |
| huGSKB-9 | 952 | 13096 | CCUACAUCUGUUCUCGCUA | 13107 | UAGCGAGAACAGAUGUAGG |
| huGSKB-10 | 571 | 13097 | UCCAGGACAAGAGGUUCAA | 13108 | UUGAACCUCUUGUCCUGGA |
| huGSKB-11 | 645 | 13098 | AGAUACUUUUUCUACUCCA | 13109 | UGGAGUAGAAAAAGUAUCU |

Human GSK beta duplexes correspond to the mouse GSK beta duplexes as follows:

| Mouse Duplex | Human Duplex |
| --- | --- |
| AD-18833 | huGSKB-1 |
| AD-18834 | huGSKB-2 |
| AD-18835 | huGSKB-3 |
| AD-18836 | huGSKB-4 |
| AD-18837 | huGSKB-5 |
| AD-18838 | huGSKB-6 |
| AD-18839 | huGSKB-7 |
| AD-18841 | huGSKB-8 |

TABLE 7-continued

Sequences of duplexes targeting Human GSK3-beta
Target sequence start identifies first nucleotide in target sequence in human
GSK3-beta mRNA NM_019884. Unmodified sense strand is identical to target
sequence. Unmodified antisense strand is complementary to target sequence.

| | |
|---|---|
| AD-18842 | huGSKB-9 |
| AD-18843 | huGSKB-10 |
| AD-18844 | huGSKB-11 |

SEQUENCE LISTING (13110 sequences)

SEQ ID NO: 1 - RNA, 19 nt, Artificial Sequence
  source: /note="Description of Artificial Sequence: Synthetic oligonucleotide"
aacugcagauuaugcguaa

SEQ ID NO: 2 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugcagauuaugcguaatt

SEQ ID NO: 3 - RNA, 19 nt, Artificial Sequence
  source: /note="Description of Artificial Sequence: Synthetic oligonucleotide"
uuacgcauaaucugcaguu

SEQ ID NO: 4 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacgcauaaucugcaguutt

SEQ ID NO: 5 - RNA, 19 nt, Artificial Sequence
  source: /note="Description of Artificial Sequence: Synthetic oligonucleotide"
acagauuacaccucgucca

SEQ ID NO: 6 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagauuacaccucguccatt

SEQ ID NO: 7 - RNA, 19 nt, Artificial Sequence
  source: /note="Description of Artificial Sequence: Synthetic oligonucleotide"
uggacgagguguaaucugu

SEQ ID NO: 8 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacgagguguaaucugutt

SEQ ID NO: 9 - RNA, 19 nt, Artificial Sequence
  source: /note="Description of Artificial Sequence: Synthetic oligonucleotide"
ggcggcgggaaagcgucag

SEQ ID NO: 10 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcgggaaagcgucagtt

SEQ ID NO: 11 - RNA, 19 nt, Artificial Sequence
  source: /note="Description of Artificial Sequence: Synthetic oligonucleotide"
cugacgcuuucccgccgcc

SEQ ID NO: 12 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacgcuuucccgccgcctt

SEQ ID NO: 13 - RNA, 19 nt, Artificial Sequence
  source: /note="Description of Artificial Sequence: Synthetic oligonucleotide"
ggcgcggaccagcucguuc

SEQ ID NO: 14 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcggaccagcucguuctt

SEQ ID NO: 15 - RNA, 19 nt, Artificial Sequence
  source: /note="Description of Artificial Sequence: Synthetic oligonucleotide"
gaacgagcugguccgcgcc

SEQ ID NO: 16 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacgagcugguccgcgcctt

SEQ ID NO: 17 - RNA, 19 nt, Artificial Sequence
  source: /note="Description of Artificial Sequence: Synthetic oligonucleotide"
ccuacuggaguacacgcca

SEQ ID NO: 18 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacuggaguacacgccatt

SEQ ID NO: 19 - RNA, 19 nt, Artificial Sequence
  source: /note="Description of Artificial Sequence: Synthetic oligonucleotide"
uggcguguacuccaguagg

SEQ ID NO: 20 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcguguacuccaguaggtt

SEQ ID NO: 21 - RNA, 19 nt, Artificial Sequence
  source: /note="Description of Artificial Sequence: Synthetic oligonucleotide"
uacuggaguacacgccauc

SEQ ID NO: 22 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuggaguacacgccauctt

SEQ ID NO: 23 - RNA, 19 nt, Artificial Sequence
  source: /note="Description of Artificial Sequence: Synthetic oligonucleotide"
gauggcguguacuccagua

SEQ ID NO: 24 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcguguacuccaguatt

SEQ ID NO: 25 - RNA, 19 nt, Artificial Sequence
  source: /note="Description of Artificial Sequence: Synthetic oligonucleotide"
cacagauuacaccucgucc

SEQ ID NO: 26 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagauuacaccucgucctt

SEQ ID NO: 27 - RNA, 19 nt, Artificial Sequence
  source: /note="Description of Artificial Sequence: Synthetic oligonucleotide"
ggacgagguguaaucugug

SEQ ID NO: 28 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacgagguguaaucugugtt

SEQ ID NO: 29 - RNA, 19 nt, Artificial Sequence
  source: /note="Description of Artificial Sequence: Synthetic oligonucleotide"
ccuaacuauacggaguuca

SEQ ID NO: 30 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaacuauacggaguucatt

SEQ ID NO: 31 - RNA, 19 nt, Artificial Sequence
  source: /note="Description of Artificial Sequence: Synthetic oligonucleotide"
ugaacuccguauaguuagg

SEQ ID NO: 32 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacuccguauaguuaggtt

SEQ ID NO: 33 - RNA, 19 nt, Artificial Sequence
  source: /note="Description of Artificial Sequence: Synthetic oligonucleotide"
gcgggcacuagcuucccgc

SEQ ID NO: 34 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggcacuagcuucccgctt

SEQ ID NO: 35 - RNA, 19 nt, Artificial Sequence
  source: /note="Description of Artificial Sequence: Synthetic oligonucleotide"
gcgggaagcuagugcccgc

SEQ ID NO: 36 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggaagcuagugcccgctt

SEQ ID NO: 37 - RNA, 19 nt, Artificial Sequence
  source: /note="Description of Artificial Sequence: Synthetic oligonucleotide"
ugaacccuaacuauacgga

SEQ ID NO: 38 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacccuaacuauacggatt

SEQ ID NO: 39 - RNA, 19 nt, Artificial Sequence
  source: /note="Description of Artificial Sequence: Synthetic oligonucleotide"
uccguauaguuaggguuca

SEQ ID NO: 40 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccguauaguuaggguucatt

SEQ ID NO: 41 - RNA, 19 nt, Artificial Sequence
  source: /note="Description of Artificial Sequence: Synthetic oligonucleotide"
acccuaacuauacggaguu

SEQ ID NO: 42 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccuaacuauacggaguutt

SEQ ID NO: 43 - RNA, 19 nt, Artificial Sequence
  source: /note="Description of Artificial Sequence: Synthetic oligonucleotide"
aacuccguauaguuagggu

SEQ ID NO: 44 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuccguauaguuagggutt

SEQ ID NO: 45 - RNA, 19 nt, Artificial Sequence
  source: /note="Description of Artificial Sequence: Synthetic oligonucleotide"
cccuaacuauacggaguuc

SEQ ID NO: 46 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuaacuauacggaguuctt

SEQ ID NO: 47 - RNA, 19 nt, Artificial Sequence
  source: /note="Description of Artificial Sequence: Synthetic oligonucleotide"
gaacuccguauaguuaggg

SEQ ID NO: 48 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuccguauaguuagggtt

SEQ ID NO: 49 - RNA, 19 nt, Artificial Sequence
  source: /note="Description of Artificial Sequence: Synthetic oligonucleotide"
aacccuaacuauacggagu

SEQ ID NO: 50 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacccuaacuauacggagutt

SEQ ID NO: 51 - RNA, 19 nt, Artificial Sequence
  source: /note="Description of Artificial Sequence: Synthetic oligonucleotide"
acuccguauaguuaggguu

SEQ ID NO: 52 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccguauaguuaggguutt

SEQ ID NO: 53 - RNA, 19 nt, Artificial Sequence
  source: /note="Description of Artificial Sequence: Synthetic oligonucleotide"
gcccccuggguguaaauag

SEQ ID NO: 54 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccuggguguaaauagtt

SEQ ID NO: 55 - RNA, 19 nt, Artificial Sequence
  source: /note="Description of Artificial Sequence: Synthetic oligonucleotide"
cuauuuacacccagggggc

SEQ ID NO: 56 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauuuacacccagggggctt

SEQ ID NO: 57 - RNA, 19 nt, Artificial Sequence
  source: /note="Description of Artificial Sequence: Synthetic oligonucleotide"
ugacaacgaagccgacggc

SEQ ID NO: 58 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacaacgaagccgacggctt

SEQ ID NO: 59 - RNA, 19 nt, Artificial Sequence
  source: /note="Description of Artificial Sequence: Synthetic oligonucleotide"
gccgucggcuucguuguca

SEQ ID NO: 60 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgucggcuucguugucatt

SEQ ID NO: 61 - RNA, 19 nt, Artificial Sequence
  source: /note="Description of Artificial Sequence: Synthetic oligonucleotide"
gccacagauuacaccucgu

SEQ ID NO: 62 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacagauuacaccucgutt

SEQ ID NO: 63 - RNA, 19 nt, Artificial Sequence
  source: /note="Description of Artificial Sequence: Synthetic oligonucleotide"
acgagguguaaucuguggc

SEQ ID NO: 64 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgagguguaaucuguggctt

SEQ ID NO: 65 - RNA, 19 nt, Artificial Sequence
  source: /note="Description of Artificial Sequence: Synthetic oligonucleotide"
agcccaucucucgucuucc

SEQ ID NO: 66 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaucucucgucuucctt

SEQ ID NO: 67 - RNA, 19 nt, Artificial Sequence
  source: /note="Description of Artificial Sequence: Synthetic oligonucleotide"
ggaagacgagagaugggcu

SEQ ID NO: 68 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagacgagagaugggcutt

SEQ ID NO: 69 - RNA, 19 nt, Artificial Sequence
  source: /note="Description of Artificial Sequence: Synthetic oligonucleotide"
gugacaacgaagccgacgg

SEQ ID NO: 70 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugacaacgaagccgacggtt

SEQ ID NO: 71 - RNA, 19 nt, Artificial Sequence
  source: /note="Description of Artificial Sequence: Synthetic oligonucleotide"
ccgucggcuucguugucac

SEQ ID NO: 72 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgucggcuucguugucactt

SEQ ID NO: 73 - RNA, 19 nt, Artificial Sequence
  source: /note="Description of Artificial Sequence: Synthetic oligonucleotide"
cucguccaucgaugugugg

SEQ ID NO: 74 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucguccaucgauguguggtt

SEQ ID NO: 75 - RNA, 19 nt, Artificial Sequence
  source: /note="Description of Artificial Sequence: Synthetic oligonucleotide"
ccacacaucgauggacgag

SEQ ID NO: 76 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacacaucgauggacgagtt

SEQ ID NO: 77 - RNA, 19 nt, Artificial Sequence
  source: /note="Description of Artificial Sequence: Synthetic oligonucleotide"
aaacgucaauucacaccau

SEQ ID NO: 78 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacgucaauucacaccautt

SEQ ID NO: 79 - RNA, 19 nt, Artificial Sequence
  source: /note="Description of Artificial Sequence: Synthetic oligonucleotide"
auggugugaauugacguuu

SEQ ID NO: 80 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggugugaauugacguuutt

SEQ ID NO: 81 - RNA, 19 nt, Artificial Sequence
  source: /note="Description of Artificial Sequence: Synthetic oligonucleotide"
acgucaauucacaccauuc

SEQ ID NO: 82 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgucaauucacaccauuctt

SEQ ID NO: 83 - RNA, 19 nt, Artificial Sequence
  source: /note="Description of Artificial Sequence: Synthetic oligonucleotide"
gaauggugugaauugacgu

SEQ ID NO: 84 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauggugugaauugacgutt

SEQ ID NO: 85 - RNA, 19 nt, Artificial Sequence
  source: /note="Description of Artificial Sequence: Synthetic oligonucleotide"
cucguucgcggagccagga

SEQ ID NO: 86 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucguucgcggagccaggatt

SEQ ID NO: 87 - RNA, 19 nt, Artificial Sequence
  source: /note="Description of Artificial Sequence: Synthetic oligonucleotide"
uccuggcuccgcgaacgag

SEQ ID NO: 88 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuggcuccgcgaacgagtt

SEQ ID NO: 89 - RNA, 19 nt, Artificial Sequence
  source: /note="Description of Artificial Sequence: Synthetic oligonucleotide"
cgcggaccagcucguucgc

SEQ ID NO: 90 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggaccagcucguucgctt

SEQ ID NO: 91 - RNA, 19 nt, Artificial Sequence
  source: /note="Description of Artificial Sequence: Synthetic oligonucleotide"
gcgaacgagcugguccgcg

SEQ ID NO: 92 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgaacgagcugguccgcgtt

SEQ ID NO: 93 - RNA, 19 nt, Artificial Sequence
  source: /note="Description of Artificial Sequence: Synthetic oligonucleotide"
cggaguaguauaccaggca

SEQ ID NO: 94 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaguaguauaccaggcatt

SEQ ID NO: 95 - RNA, 19 nt, Artificial Sequence
  source: /note="Description of Artificial Sequence: Synthetic oligonucleotide"
ugccugguauacuacuccg

SEQ ID NO: 96 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccugguauacuacuccgtt

SEQ ID NO: 97 - RNA, 19 nt, Artificial Sequence
  source: /note="Description of Artificial Sequence: Synthetic oligonucleotide"
agauuacaccucguccauc

SEQ ID NO: 98 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuacaccucguccauctt

SEQ ID NO: 99 - RNA, 19 nt, Artificial Sequence
  source: /note="Description of Artificial Sequence: Synthetic oligonucleotide"
gauggacgagguguaaucu

SEQ ID NO: 100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggacgagguguaaucutt

SEQ ID NO: 101 - RNA, 19 nt, Artificial Sequence
  source: /note="Description of Artificial Sequence: Synthetic oligonucleotide"
aaaacgucaauucacacca

SEQ ID NO: 102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaacgucaauucacaccatt

SEQ ID NO: 103 - RNA, 19 nt, Artificial Sequence
  source: /note="Description of Artificial Sequence: Synthetic oligonucleotide"
uggugugaauugacguuuu

SEQ ID NO: 104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugugaauugacguuuutt

SEQ ID NO: 105 - RNA, 19 nt, Artificial Sequence
  source: /note="Description of Artificial Sequence: Synthetic oligonucleotide"
gacaacgaagccgacggca

SEQ ID NO: 106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaacgaagccgacggcatt

SEQ ID NO: 107 - RNA, 19 nt, Artificial Sequence
  source: /note="Description of Artificial Sequence: Synthetic oligonucleotide"
ugccgucggcuucguuguc

SEQ ID NO: 108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccgucggcuucguuguctt

SEQ ID NO: 109 - RNA, 19 nt, Artificial Sequence
  source: /note="Description of Artificial Sequence: Synthetic oligonucleotide"
ccgacggcagagggacuuc

SEQ ID NO: 110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgacggcagagggacuuctt

SEQ ID NO: 111 - RNA, 19 nt, Artificial Sequence
  source: /note="Description of Artificial Sequence: Synthetic oligonucleotide"
gaagucccucugccgucgg

SEQ ID NO: 112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagucccucugccgucggtt

SEQ ID NO: 113 - RNA, 19 nt, Artificial Sequence
  source: /note="Description of Artificial Sequence: Synthetic oligonucleotide"
cggaccagcucguucgcgg

SEQ ID NO: 114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaccagcucguucgcggtt

SEQ ID NO: 115 - RNA, 19 nt, Artificial Sequence
  source: /note="Description of Artificial Sequence: Synthetic oligonucleotide"
ccgcgaacgagcugguccg

SEQ ID NO: 116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcgaacgagcugguccgtt

SEQ ID NO: 117 - RNA, 19 nt, Artificial Sequence
  source: /note="Description of Artificial Sequence: Synthetic oligonucleotide"
ggaccagcucguucgcgga

SEQ ID NO: 118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccagcucguucgcggatt

SEQ ID NO: 119 - RNA, 19 nt, Artificial Sequence
  source: /note="Description of Artificial Sequence: Synthetic oligonucleotide"
uccgcgaacgagcuggucc

SEQ ID NO: 120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgcgaacgagcuggucctt

SEQ ID NO: 121 - RNA, 19 nt, Artificial Sequence
  source: /note="Description of Artificial Sequence: Synthetic oligonucleotide"
cuggcggcgggaaagcguc

SEQ ID NO: 122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcggcgggaaagcguctt

SEQ ID NO: 123 - RNA, 19 nt, Artificial Sequence
  source: /note="Description of Artificial Sequence: Synthetic oligonucleotide"
gacgcuuucccgccgccag

SEQ ID NO: 124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgcuuucccgccgccagtt

SEQ ID NO: 125 - RNA, 19 nt, Artificial Sequence
  source: /note="Description of Artificial Sequence: Synthetic oligonucleotide"
gcggcgggaaagcgucagu

SEQ ID NO: 126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcgggaaagcgucagutt

SEQ ID NO: 127 - RNA, 19 nt, Artificial Sequence
  source: /note="Description of Artificial Sequence: Synthetic oligonucleotide"
acugacgcuuucccgccgc

SEQ ID NO: 128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugacgcuuucccgccgctt

SEQ ID NO: 129 - RNA, 19 nt, Artificial Sequence
  source: /note="Description of Artificial Sequence: Synthetic oligonucleotide"
aagcgucagucggggcuau

SEQ ID NO: 130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcgucagucggggcuautt

SEQ ID NO: 131 - RNA, 19 nt, Artificial Sequence
  source: /note="Description of Artificial Sequence: Synthetic oligonucleotide"
auagccccgacugacgcuu

SEQ ID NO: 132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagccccgacugacgcuutt

SEQ ID NO: 133 - RNA, 19 nt, Artificial Sequence
  source: /note="Description of Artificial Sequence: Synthetic oligonucleotide"
ggcgcgggcacuagcuucc

SEQ ID NO: 134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcgggcacuagcuucctt

SEQ ID NO: 135 - RNA, 19 nt, Artificial Sequence
  source: /note="Description of Artificial Sequence: Synthetic oligonucleotide"
ggaagcuagugcccgcgcc

SEQ ID NO: 136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagcuagugcccgcgcctt

SEQ ID NO: 137 - RNA, 19 nt, Artificial Sequence
  source: /note="Description of Artificial Sequence: Synthetic oligonucleotide"
gguucaagaaccgagaacu

SEQ ID NO: 138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucaagaaccgagaacutt

SEQ ID NO: 139 - RNA, 19 nt, Artificial Sequence
  source: /note="Description of Artificial Sequence: Synthetic oligonucleotide"
aguucucgguucuugaacc

SEQ ID NO: 140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucucgguucuugaacctt

SEQ ID NO: 141 - RNA, 19 nt, Artificial Sequence
  source: /note="Description of Artificial Sequence: Synthetic oligonucleotide"
ccuacaucugcucucggua

SEQ ID NO: 142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacaucugcucucgguatt

SEQ ID NO: 143 - RNA, 19 nt, Artificial Sequence
  source: /note="Description of Artificial Sequence: Synthetic oligonucleotide"
uaccgagagcagauguagg

SEQ ID NO: 144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgagagcagauguaggtt

SEQ ID NO: 145 - RNA, 19 nt, Artificial Sequence
  source: /note="Description of Artificial Sequence: Synthetic oligonucleotide"
cagauuacaccucguccau

SEQ ID NO: 146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauuacaccucguccautt

SEQ ID NO: 147 - RNA, 19 nt, Artificial Sequence
  source: /note="Description of Artificial Sequence: Synthetic oligonucleotide"
auggacgagguguaaucug

SEQ ID NO: 148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggacgagguguaaucugtt

SEQ ID NO: 149 - RNA, 19 nt, Artificial Sequence
  source: /note="Description of Artificial Sequence: Synthetic oligonucleotide"
uccaucgauguguggucgg

SEQ ID NO: 150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaucgauguguggucggtt

SEQ ID NO: 151 - RNA, 19 nt, Artificial Sequence
  source: /note="Description of Artificial Sequence: Synthetic oligonucleotide"
ccgaccacacaucgaugga

SEQ ID NO: 152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaccacacaucgauggatt

SEQ ID NO: 153 - RNA, 19 nt, Artificial Sequence
  source: /note="Description of Artificial Sequence: Synthetic oligonucleotide"
ccaucgauguguggucggc

SEQ ID NO: 154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucgauguguggucggctt

SEQ ID NO: 155 - RNA, 19 nt, Artificial Sequence
  source: /note="Description of Artificial Sequence: Synthetic oligonucleotide"
gccgaccacacaucgaugg

SEQ ID NO: 156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgaccacacaucgauggtt

SEQ ID NO: 157 - RNA, 19 nt, Artificial Sequence
  source: /note="Description of Artificial Sequence: Synthetic oligonucleotide"
aucgauguguggucggcug

SEQ ID NO: 158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgauguguggucggcugtt

SEQ ID NO: 159 - RNA, 19 nt, Artificial Sequence
  source: /note="Description of Artificial Sequence: Synthetic oligonucleotide"
cagccgaccacacaucgau

SEQ ID NO: 160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccgaccacacaucgautt

SEQ ID NO: 161 - RNA, 19 nt, Artificial Sequence
  source: /note="Description of Artificial Sequence: Synthetic oligonucleotide"
ucgauguguggucggcugg

SEQ ID NO: 162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgauguguggucggcuggtt

SEQ ID NO: 163 - RNA, 19 nt, Artificial Sequence
  source: /note="Description of Artificial Sequence: Synthetic oligonucleotide"
ccagccgaccacacaucga

SEQ ID NO: 164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagccgaccacacaucgatt

SEQ ID NO: 165 - RNA, 19 nt, Artificial Sequence
  source: /note="Description of Artificial Sequence: Synthetic oligonucleotide"
augaacccuaacuauacgg

SEQ ID NO: 166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaacccuaacuauacggtt

SEQ ID NO: 167 - RNA, 19 nt, Artificial Sequence
  source: /note="Description of Artificial Sequence: Synthetic oligonucleotide"
ccguauaguuaggguucau

SEQ ID NO: 168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccguauaguuaggguucautt

SEQ ID NO: 169 - RNA, 19 nt, Artificial Sequence
  source: /note="Description of Artificial Sequence: Synthetic oligonucleotide"
aguacacgccauccucaag

SEQ ID NO: 170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguacacgccauccucaagtt

SEQ ID NO: 171 - RNA, 19 nt, Artificial Sequence
  source: /note="Description of Artificial Sequence: Synthetic oligonucleotide"
cuugaggauggcguguacu

SEQ ID NO: 172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaggauggcguguacutt

SEQ ID NO: 173 - RNA, 19 nt, Artificial Sequence
  source: /note="Description of Artificial Sequence: Synthetic oligonucleotide"
uucgaugaacugcggagac

SEQ ID NO: 174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucgaugaacugcggagactt

SEQ ID NO: 175 - RNA, 19 nt, Artificial Sequence
  source: /note="Description of Artificial Sequence: Synthetic oligonucleotide"
gucuccgcaguucaucgaa

SEQ ID NO: 176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuccgcaguucaucgaatt

SEQ ID NO: 177 - RNA, 19 nt, Artificial Sequence
  source: /note="Description of Artificial Sequence: Synthetic oligonucleotide"
ucgaugaacugcggagacu

SEQ ID NO: 178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaugaacugcggagacutt

SEQ ID NO: 179 - RNA, 19 nt, Artificial Sequence
  source: /note="Description of Artificial Sequence: Synthetic oligonucleotide"
agucuccgcaguucaucga

SEQ ID NO: 180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucuccgcaguucaucgatt

SEQ ID NO: 181 - RNA, 19 nt, Artificial Sequence
  source: /note="Description of Artificial Sequence: Synthetic oligonucleotide"
uccaaccaucucucaaugc

SEQ ID NO: 182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaccaucucucaaugctt

SEQ ID NO: 183 - RNA, 19 nt, Artificial Sequence
  source: /note="Description of Artificial Sequence: Synthetic oligonucleotide"
gcauugagagaugguugga

SEQ ID NO: 184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcauugagagaugguuggatt

SEQ ID NO: 185 - RNA, 19 nt, Artificial Sequence
  source: /note="Description of Artificial Sequence: Synthetic oligonucleotide"
cagcccaucucucgucuuc

SEQ ID NO: 186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccaucucucgucuuctt

SEQ ID NO: 187 - RNA, 19 nt, Artificial Sequence
  source: /note="Description of Artificial Sequence: Synthetic oligonucleotide"
gaagacgagagaugggcug

SEQ ID NO: 188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagacgagagaugggcugtt

SEQ ID NO: 189 - RNA, 19 nt, Artificial Sequence
  source: /note="Description of Artificial Sequence: Synthetic oligonucleotide"
cccccuggguguaaauaga

SEQ ID NO: 190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccuggguguaaauagatt

SEQ ID NO: 191 - RNA, 19 nt, Artificial Sequence
  source: /note="Description of Artificial Sequence: Synthetic oligonucleotide"
ucuauuuacacccaggggg

SEQ ID NO: 192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuauuuacacccagggggtt

SEQ ID NO: 193 - RNA, 19 nt, Artificial Sequence
  source: /note="Description of Artificial Sequence: Synthetic oligonucleotide"
gaaaacgucaauucacacc

SEQ ID NO: 194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaacgucaauucacacctt

SEQ ID NO: 195 - RNA, 19 nt, Artificial Sequence
  source: /note="Description of Artificial Sequence: Synthetic oligonucleotide"
ggugugaauugacguuuuc

SEQ ID NO: 196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugugaauugacguuuuctt

SEQ ID NO: 197 - RNA, 19 nt, Artificial Sequence
  source: /note="Description of Artificial Sequence: Synthetic oligonucleotide"
ucacaccauucaacuugcc

SEQ ID NO: 198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacaccauucaacuugcctt

SEQ ID NO: 199 - RNA, 19 nt, Artificial Sequence
  source: /note="Description of Artificial Sequence: Synthetic oligonucleotide"
ggcaaguugaaugguguga

SEQ ID NO: 200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaaguugaauggugugatt

SEQ ID NO: 201 - RNA, 19 nt, Artificial Sequence
  source: /note="Description of Artificial Sequence: Synthetic oligonucleotide"
caccauucaacuugccccc

SEQ ID NO: 202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccauucaacuugccccctt

SEQ ID NO: 203 - RNA, 19 nt, Artificial Sequence
  source: /note="Description of Artificial Sequence: Synthetic oligonucleotide"
gggggcaaguugaauggug

SEQ ID NO: 204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggcaaguugaauggugtt

SEQ ID NO: 205 - RNA, 19 nt, Artificial Sequence
  source: /note="Description of Artificial Sequence: Synthetic oligonucleotide"
accauucaacuugcccccc

SEQ ID NO: 206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accauucaacuugcccccctt

SEQ ID NO: 207 - RNA, 19 nt, Artificial Sequence
  source: /note="Description of Artificial Sequence: Synthetic oligonucleotide"
ggggggcaaguugaauggu

SEQ ID NO: 208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggggcaaguugaauggutt

SEQ ID NO: 209 - RNA, 19 nt, Artificial Sequence
  source: /note="Description of Artificial Sequence: Synthetic oligonucleotide"
cauucaacuugcccccccc

SEQ ID NO: 210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauucaacuugcccccccctt

SEQ ID NO: 211 - RNA, 19 nt, Artificial Sequence
  source: /note="Description of Artificial Sequence: Synthetic oligonucleotide"
ggggggggcaaguugaaug

SEQ ID NO: 212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggggggcaaguugaaugtt

SEQ ID NO: 213 - RNA, 19 nt, Artificial Sequence
  source: /note="Description of Artificial Sequence: Synthetic oligonucleotide"
uuggcaugaaacccuuaaa

SEQ ID NO: 214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcaugaaacccuuaaatt

SEQ ID NO: 215 - RNA, 19 nt, Artificial Sequence
  source: /note="Description of Artificial Sequence: Synthetic oligonucleotide"
uuuaaggguuucaugccaa

SEQ ID NO: 216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaaggguuucaugccaatt

SEQ ID NO: 217 - RNA, 19 nt, Artificial Sequence
  source: /note="Description of Artificial Sequence: Synthetic oligonucleotide"
agccggagcccgaacggcg

SEQ ID NO: 218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccggagcccgaacggcgtt

SEQ ID NO: 219 - RNA, 19 nt, Artificial Sequence
  source: /note="Description of Artificial Sequence: Synthetic oligonucleotide"
cgccguucgggcuccggcu

SEQ ID NO: 220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccguucgggcuccggcutt

SEQ ID NO: 221 - RNA, 19 nt, Artificial Sequence
  source: /note="Description of Artificial Sequence: Synthetic oligonucleotide"
ccugcgcucggcgccauga

SEQ ID NO: 222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugcgcucggcgccaugatt

SEQ ID NO: 223 - RNA, 19 nt, Artificial Sequence
  source: /note="Description of Artificial Sequence: Synthetic oligonucleotide"
ucauggcgccgagcgcagg

SEQ ID NO: 224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauggcgccgagcgcaggtt

SEQ ID NO: 225 - RNA, 19 nt, Artificial Sequence
  source: /note="Description of Artificial Sequence: Synthetic oligonucleotide"
caccccuaucaucuacauc

SEQ ID NO: 226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccccuaucaucuacauctt

SEQ ID NO: 227 - RNA, 19 nt, Artificial Sequence
  source: /note="Description of Artificial Sequence: Synthetic oligonucleotide"
gauguagaugauaggggug

SEQ ID NO: 228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauguagaugauaggggugtt

SEQ ID NO: 229 - RNA, 19 nt, Artificial Sequence
  source: /note="Description of Artificial Sequence: Synthetic oligonucleotide"
gccccagaauuugcuugug

SEQ ID NO: 230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccagaauuugcuugugtt

SEQ ID NO: 231 - RNA, 19 nt, Artificial Sequence
  source: /note="Description of Artificial Sequence: Synthetic oligonucleotide"
cacaagcaaauucuggggc

SEQ ID NO: 232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaagcaaauucuggggctt

SEQ ID NO: 233 - RNA, 19 nt, Artificial Sequence
  source: /note="Description of Artificial Sequence: Synthetic oligonucleotide"
gguucggggggagcccaau

SEQ ID NO: 234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucggggggagcccaautt

SEQ ID NO: 235 - RNA, 19 nt, Artificial Sequence
  source: /note="Description of Artificial Sequence: Synthetic oligonucleotide"
auugggcuccccccgaacc

SEQ ID NO: 236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugggcuccccccgaacctt

SEQ ID NO: 237 - RNA, 19 nt, Artificial Sequence
  source: /note="Description of Artificial Sequence: Synthetic oligonucleotide"
caucgauguguggucggcu

SEQ ID NO: 238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucgauguguggucggcutt

SEQ ID NO: 239 - RNA, 19 nt, Artificial Sequence
  source: /note="Description of Artificial Sequence: Synthetic oligonucleotide"
agccgaccacacaucgaug

SEQ ID NO: 240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccgaccacacaucgaugtt

SEQ ID NO: 241 - RNA, 19 nt, Artificial Sequence
  source: /note="Description of Artificial Sequence: Synthetic oligonucleotide"
acucugcucuagccuacug

SEQ ID NO: 242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucugcucuagccuacugtt

SEQ ID NO: 243 - RNA, 19 nt, Artificial Sequence
  source: /note="Description of Artificial Sequence: Synthetic oligonucleotide"
caguaggcuagagcagagu

SEQ ID NO: 244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguaggcuagagcagagutt

SEQ ID NO: 245 - RNA, 19 nt, Artificial Sequence
  source: /note="Description of Artificial Sequence: Synthetic oligonucleotide"
agccuacuggaguacacgc

SEQ ID NO: 246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuacuggaguacacgctt

SEQ ID NO: 247 - RNA, 19 nt, Artificial Sequence
  source: /note="Description of Artificial Sequence: Synthetic oligonucleotide"
gcguguacuccaguaggcu

SEQ ID NO: 248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcguguacuccaguaggcutt

SEQ ID NO: 249 - RNA, 19 nt, Artificial Sequence
  source: /note="Description of Artificial Sequence: Synthetic oligonucleotide"
gccuacuggaguacacgcc

SEQ ID NO: 250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuacuggaguacacgcctt

SEQ ID NO: 251 - RNA, 19 nt, Artificial Sequence
  source: /note="Description of Artificial Sequence: Synthetic oligonucleotide"
ggcguguacuccaguaggc

SEQ ID NO: 252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcguguacuccaguaggctt

SEQ ID NO: 253 - RNA, 19 nt, Artificial Sequence
  source: /note="Description of Artificial Sequence: Synthetic oligonucleotide"
uuucuuaaagaaaacguca

SEQ ID NO: 254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuuaaagaaaacgucatt

SEQ ID NO: 255 - RNA, 19 nt, Artificial Sequence
  source: /note="Description of Artificial Sequence: Synthetic oligonucleotide"
ugacguuuucuuuaagaaa

SEQ ID NO: 256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacguuuucuuuaagaaatt

SEQ ID NO: 257 - RNA, 19 nt, Artificial Sequence
  source: /note="Description of Artificial Sequence: Synthetic oligonucleotide"
agaaaacgucaauucacac

SEQ ID NO: 258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaacgucaauucacactt

SEQ ID NO: 259 - RNA, 19 nt, Artificial Sequence
  source: /note="Description of Artificial Sequence: Synthetic oligonucleotide"
gugugaauugacguuuucu

SEQ ID NO: 260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugugaauugacguuuucutt

SEQ ID NO: 261 - RNA, 19 nt, Artificial Sequence
  source: /note="Description of Artificial Sequence: Synthetic oligonucleotide"
caauucacaccauucaacu

SEQ ID NO: 262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauucacaccauucaacutt

SEQ ID NO: 263 - RNA, 19 nt, Artificial Sequence
  source: /note="Description of Artificial Sequence: Synthetic oligonucleotide"
aguugaauggugugaauug

SEQ ID NO: 264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguugaauggugugaauugtt

SEQ ID NO: 265 - RNA, 19 nt, Artificial Sequence
  source: /note="Description of Artificial Sequence: Synthetic oligonucleotide"
ucaacuugccccccccagc

SEQ ID NO: 266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaacuugccccccccagctt

SEQ ID NO: 267 - RNA, 19 nt, Artificial Sequence
  source: /note="Description of Artificial Sequence: Synthetic oligonucleotide"
gcuggggggggcaaguuga

SEQ ID NO: 268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggggggggcaaguugatt

SEQ ID NO: 269 - RNA, 19 nt, Artificial Sequence
  source: /note="Description of Artificial Sequence: Synthetic oligonucleotide"
guucaauaaauuauuggca

SEQ ID NO: 270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaauaaauuauuggcatt

SEQ ID NO: 271 - RNA, 19 nt, Artificial Sequence
  source: /note="Description of Artificial Sequence: Synthetic oligonucleotide"
ugccaauaauuuauugaac

SEQ ID NO: 272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaauaauuuauugaactt

SEQ ID NO: 273 - RNA, 19 nt, Artificial Sequence
  source: /note="Description of Artificial Sequence: Synthetic oligonucleotide"
ccuucgggaggcggcccug

SEQ ID NO: 274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucgggaggcggcccugtt

SEQ ID NO: 275 - RNA, 19 nt, Artificial Sequence
  source: /note="Description of Artificial Sequence: Synthetic oligonucleotide"
cagggccgccucccgaagg

SEQ ID NO: 276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggccgccucccgaaggtt

SEQ ID NO: 277 - RNA, 19 nt, Artificial Sequence
  source: /note="Description of Artificial Sequence: Synthetic oligonucleotide"
gcgcggaccagcucguucg

SEQ ID NO: 278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcggaccagcucguucgtt

SEQ ID NO: 279 - RNA, 19 nt, Artificial Sequence
  source: /note="Description of Artificial Sequence: Synthetic oligonucleotide"
cgaacgagcugguccgcgc

SEQ ID NO: 280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaacgagcugguccgcgctt

SEQ ID NO: 281 - RNA, 19 nt, Artificial Sequence
  source: /note="Description of Artificial Sequence: Synthetic oligonucleotide"
gcggaccagcucguucgcg

SEQ ID NO: 282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggaccagcucguucgcgtt

SEQ ID NO: 283 - RNA, 19 nt, Artificial Sequence
  source: /note="Description of Artificial Sequence: Synthetic oligonucleotide"
cgcgaacgagcugguccgc

SEQ ID NO: 284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcgaacgagcugguccgctt

SEQ ID NO: 285 - RNA, 19 nt, Artificial Sequence
  source: /note="Description of Artificial Sequence: Synthetic oligonucleotide"
agcucguucgcggagccag

SEQ ID NO: 286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucguucgcggagccagtt

SEQ ID NO: 287 - RNA, 19 nt, Artificial Sequence
  source: /note="Description of Artificial Sequence: Synthetic oligonucleotide"
cuggcuccgcgaacgagcu

SEQ ID NO: 288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcuccgcgaacgagcutt

SEQ ID NO: 289 - RNA, 19 nt, Artificial Sequence
  source: /note="Description of Artificial Sequence: Synthetic oligonucleotide"
ucguucgcggagccaggag

SEQ ID NO: 290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucguucgcggagccaggagtt

SEQ ID NO: 291 - RNA, 19 nt, Artificial Sequence
  source: /note="Description of Artificial Sequence: Synthetic oligonucleotide"
cuccuggcuccgcgaacga

SEQ ID NO: 292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuggcuccgcgaacgatt

SEQ ID NO: 293 - RNA, 19 nt, Artificial Sequence
  source: /note="Description of Artificial Sequence: Synthetic oligonucleotide"
ggcacuggcggcgggaaag

SEQ ID NO: 294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacuggcggcgggaaagtt

SEQ ID NO: 295 - RNA, 19 nt, Artificial Sequence
  source: /note="Description of Artificial Sequence: Synthetic oligonucleotide"
cuuucccgccgccagugcc

SEQ ID NO: 296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucccgccgccagugcctt

SEQ ID NO: 297 - RNA, 19 nt, Artificial Sequence
  source: /note="Description of Artificial Sequence: Synthetic oligonucleotide"
uggcggcgggaaagcguca

SEQ ID NO: 298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcggcgggaaagcgucatt

SEQ ID NO: 299 - RNA, 19 nt, Artificial Sequence
  source: /note="Description of Artificial Sequence: Synthetic oligonucleotide"
ugacgcuuucccgccgcca

SEQ ID NO: 300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacgcuuucccgccgccatt

SEQ ID NO: 301 - RNA, 19 nt, Artificial Sequence
  source: /note="Description of Artificial Sequence: Synthetic oligonucleotide"
gccccggcgcgggcacuag

SEQ ID NO: 302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccggcgcgggcacuagtt

SEQ ID NO: 303 - RNA, 19 nt, Artificial Sequence
  source: /note="Description of Artificial Sequence: Synthetic oligonucleotide"
cuagugcccgcgccggggc

SEQ ID NO: 304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagugcccgcgccggggctt

SEQ ID NO: 305 - RNA, 19 nt, Artificial Sequence
  source: /note="Description of Artificial Sequence: Synthetic oligonucleotide"
ccccggcgcgggcacuagc

SEQ ID NO: 306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccggcgcgggcacuagctt

SEQ ID NO: 307 - RNA, 19 nt, Artificial Sequence
  source: /note="Description of Artificial Sequence: Synthetic oligonucleotide"
gcuagugcccgcgccgggg

SEQ ID NO: 308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagugcccgcgccggggtt

SEQ ID NO: 309 - RNA, 19 nt, Artificial Sequence
  source: /note="Description of Artificial Sequence: Synthetic oligonucleotide"
cccggcgcgggcacuagcu

SEQ ID NO: 310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggcgcgggcacuagcutt

SEQ ID NO: 311 - RNA, 19 nt, Artificial Sequence
  source: /note="Description of Artificial Sequence: Synthetic oligonucleotide"
agcuagugcccgcgccggg

SEQ ID NO: 312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuagugcccgcgccgggtt

SEQ ID NO: 313 - RNA, 19 nt, Artificial Sequence
  source: /note="Description of Artificial Sequence: Synthetic oligonucleotide"
ccggcgcgggcacuagcuu

SEQ ID NO: 314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcgcgggcacuagcuutt

SEQ ID NO: 315 - RNA, 19 nt, Artificial Sequence
  source: /note="Description of Artificial Sequence: Synthetic oligonucleotide"
aagcuagugcccgcgccgg

SEQ ID NO: 316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuagugcccgcgccggtt

SEQ ID NO: 317 - RNA, 19 nt, Artificial Sequence
  source: /note="Description of Artificial Sequence: Synthetic oligonucleotide"
ggcacuagcuucccgccgc

SEQ ID NO: 318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacuagcuucccgccgctt

SEQ ID NO: 319 - RNA, 19 nt, Artificial Sequence
  source: /note="Description of Artificial Sequence: Synthetic oligonucleotide"
gcggcgggaagcuagugcc

SEQ ID NO: 320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcgggaagcuagugcctt

SEQ ID NO: 321 - RNA, 19 nt, Artificial Sequence
  source: /note="Description of Artificial Sequence: Synthetic oligonucleotide"
gaguaguauaccaggcacg

SEQ ID NO: 322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguaguauaccaggcacgtt

SEQ ID NO: 323 - RNA, 19 nt, Artificial Sequence
  source: /note="Description of Artificial Sequence: Synthetic oligonucleotide"
cgugccugguauacuacuc

SEQ ID NO: 324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugccugguauacuacuctt

SEQ ID NO: 325 - RNA, 19 nt, Artificial Sequence
  source: /note="Description of Artificial Sequence: Synthetic oligonucleotide"
agguucaagaaccgagaac

SEQ ID NO: 326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguucaagaaccgagaactt

SEQ ID NO: 327 - RNA, 19 nt, Artificial Sequence
  source: /note="Description of Artificial Sequence: Synthetic oligonucleotide"
guucucgguucuugaaccu

SEQ ID NO: 328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucucgguucuugaaccutt

SEQ ID NO: 329 - RNA, 19 nt, Artificial Sequence
  source: /note="Description of Artificial Sequence: Synthetic oligonucleotide"
gagaacugcagauuaugcg

SEQ ID NO: 330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaacugcagauuaugcgtt

SEQ ID NO: 331 - RNA, 19 nt, Artificial Sequence
  source: /note="Description of Artificial Sequence: Synthetic oligonucleotide"
cgcauaaucugcaguucuc

SEQ ID NO: 332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcauaaucugcaguucuctt

SEQ ID NO: 333 - RNA, 19 nt, Artificial Sequence
  source: /note="Description of Artificial Sequence: Synthetic oligonucleotide"
agccccagaauuugcuugu

SEQ ID NO: 334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccccagaauuugcuugutt

SEQ ID NO: 335 - RNA, 19 nt, Artificial Sequence
  source: /note="Description of Artificial Sequence: Synthetic oligonucleotide"
acaagcaaauucuggggcu

SEQ ID NO: 336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagcaaauucuggggcutt

SEQ ID NO: 337 - RNA, 19 nt, Artificial Sequence
  source: /note="Description of Artificial Sequence: Synthetic oligonucleotide"
agcagcugguucgggggga

SEQ ID NO: 338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagcugguucggggggatt

SEQ ID NO: 339 - RNA, 19 nt, Artificial Sequence
  source: /note="Description of Artificial Sequence: Synthetic oligonucleotide"
uccccccgaaccagcugcu

SEQ ID NO: 340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccccgaaccagcugcutt

SEQ ID NO: 341 - RNA, 19 nt, Artificial Sequence
  source: /note="Description of Artificial Sequence: Synthetic oligonucleotide"
cggggggagcccaaugugu

SEQ ID NO: 342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggggagcccaaugugutt

SEQ ID NO: 343 - RNA, 19 nt, Artificial Sequence
  source: /note="Description of Artificial Sequence: Synthetic oligonucleotide"
acacauugggcuccccccg

SEQ ID NO: 344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacauugggcuccccccgtt

SEQ ID NO: 345 - RNA, 19 nt, Artificial Sequence
  source: /note="Description of Artificial Sequence: Synthetic oligonucleotide"
ggggagcccaauguguccu

SEQ ID NO: 346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagcccaauguguccutt

SEQ ID NO: 347 - RNA, 19 nt, Artificial Sequence
  source: /note="Description of Artificial Sequence: Synthetic oligonucleotide"
aggacacauugggcucccc

SEQ ID NO: 348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacacauugggcucccctt

SEQ ID NO: 349 - RNA, 19 nt, Artificial Sequence
  source: /note="Description of Artificial Sequence: Synthetic oligonucleotide"
ugagcuacuucucggccag

SEQ ID NO: 350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagcuacuucucggccagtt

SEQ ID NO: 351 - RNA, 19 nt, Artificial Sequence
  source: /note="Description of Artificial Sequence: Synthetic oligonucleotide"
cuggccgagaaguagcuca

SEQ ID NO: 352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggccgagaaguagcucatt

SEQ ID NO: 353 - RNA, 19 nt, Artificial Sequence
  source: /note="Description of Artificial Sequence: Synthetic oligonucleotide"
caaagacaccaccugaggc

SEQ ID NO: 354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagacaccaccugaggctt

SEQ ID NO: 355 - RNA, 19 nt, Artificial Sequence
  source: /note="Description of Artificial Sequence: Synthetic oligonucleotide"
gccucagguggugucuuug

SEQ ID NO: 356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucagguggugucuuugtt

SEQ ID NO: 357 - RNA, 19 nt, Artificial Sequence
  source: /note="Description of Artificial Sequence: Synthetic oligonucleotide"
ccaccugaggccauugcac

SEQ ID NO: 358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccugaggccauugcactt

SEQ ID NO: 359 - RNA, 19 nt, Artificial Sequence
  source: /note="Description of Artificial Sequence: Synthetic oligonucleotide"
gugcaauggccucaggugg

SEQ ID NO: 360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcaauggccucagguggtt

SEQ ID NO: 361 - RNA, 19 nt, Artificial Sequence
  source: /note="Description of Artificial Sequence: Synthetic oligonucleotide"
gcccgcuucccccccuguu

SEQ ID NO: 362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgcuucccccccuguutt

SEQ ID NO: 363 - RNA, 19 nt, Artificial Sequence
  source: /note="Description of Artificial Sequence: Synthetic oligonucleotide"
aacagggggggaagcgggc

SEQ ID NO: 364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacagggggggaagcgggctt

SEQ ID NO: 365 - RNA, 19 nt, Artificial Sequence
  source: /note="Description of Artificial Sequence: Synthetic oligonucleotide"
auccaaccaucucucaaug

SEQ ID NO: 366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccaaccaucucucaaugtt

SEQ ID NO: 367 - RNA, 19 nt, Artificial Sequence
  source: /note="Description of Artificial Sequence: Synthetic oligonucleotide"
cauugagagaugguuggau

SEQ ID NO: 368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauugagagaugguuggautt

SEQ ID NO: 369 - RNA, 19 nt, Artificial Sequence
  source: /note="Description of Artificial Sequence: Synthetic oligonucleotide"
auuuuaacuguuuguaggg

SEQ ID NO: 370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuuaacuguuuguagggtt

SEQ ID NO: 371 - RNA, 19 nt, Artificial Sequence
  source: /note="Description of Artificial Sequence: Synthetic oligonucleotide"
cccuacaaacaguuaaaau

SEQ ID NO: 372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuacaaacaguuaaaautt

SEQ ID NO: 373 - RNA, 19 nt, Artificial Sequence
  source: /note="Description of Artificial Sequence: Synthetic oligonucleotide"
uuuuaacuguuuguagggg

SEQ ID NO: 374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuaacuguuuguaggggtt

SEQ ID NO: 375 - RNA, 19 nt, Artificial Sequence
  source: /note="Description of Artificial Sequence: Synthetic oligonucleotide"
ccccuacaaacaguuaaaa

SEQ ID NO: 376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuacaaacaguuaaaatt

SEQ ID NO: 377 - RNA, 19 nt, Artificial Sequence
  source: /note="Description of Artificial Sequence: Synthetic oligonucleotide"
cucccccaggcuaccacuc

SEQ ID NO: 378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccccaggcuaccacuctt

SEQ ID NO: 379 - RNA, 19 nt, Artificial Sequence
  source: /note="Description of Artificial Sequence: Synthetic oligonucleotide"
gagugguagccugggggag

SEQ ID NO: 380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagugguagccugggggagtt

SEQ ID NO: 381 - RNA, 19 nt, Artificial Sequence
  source: /note="Description of Artificial Sequence: Synthetic oligonucleotide"
ggucccuuguaaauagaac

SEQ ID NO: 382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucccuuguaaauagaactt

SEQ ID NO: 383 - RNA, 19 nt, Artificial Sequence
  source: /note="Description of Artificial Sequence: Synthetic oligonucleotide"
guucuauuuacaagggacc

SEQ ID NO: 384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuauuuacaagggacctt

SEQ ID NO: 385 - RNA, 19 nt, Artificial Sequence
  source: /note="Description of Artificial Sequence: Synthetic oligonucleotide"
ccccuggguguaaauagau

SEQ ID NO: 386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuggguguaaauagautt

SEQ ID NO: 387 - RNA, 19 nt, Artificial Sequence
  source: /note="Description of Artificial Sequence: Synthetic oligonucleotide"
aucuauuuacacccagggg

SEQ ID NO: 388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuauuuacacccaggggtt

SEQ ID NO: 389 - RNA, 19 nt, Artificial Sequence
  source: /note="Description of Artificial Sequence: Synthetic oligonucleotide"
uggguguaaauagauuguu

SEQ ID NO: 390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggguguaaauagauuguutt

SEQ ID NO: 391 - RNA, 19 nt, Artificial Sequence
  source: /note="Description of Artificial Sequence: Synthetic oligonucleotide"
aacaaucuauuuacaccca

SEQ ID NO: 392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaaucuauuuacacccatt

SEQ ID NO: 393 - RNA, 19 nt, Artificial Sequence
  source: /note="Description of Artificial Sequence: Synthetic oligonucleotide"
cuuaaagaaaacgucaauu

SEQ ID NO: 394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuaaagaaaacgucaauutt

SEQ ID NO: 395 - RNA, 19 nt, Artificial Sequence
  source: /note="Description of Artificial Sequence: Synthetic oligonucleotide"
aauugacguuuucuuuaag

SEQ ID NO: 396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauugacguuuucuuuaagtt

SEQ ID NO: 397 - RNA, 19 nt, Artificial Sequence
  source: /note="Description of Artificial Sequence: Synthetic oligonucleotide"
uuaaagaaaacgucaauuc

SEQ ID NO: 398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaagaaaacgucaauuctt

SEQ ID NO: 399 - RNA, 19 nt, Artificial Sequence
  source: /note="Description of Artificial Sequence: Synthetic oligonucleotide"
gaauugacguuuucuuuaa

SEQ ID NO: 400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauugacguuuucuuuaatt

SEQ ID NO: 401 - RNA, 19 nt, Artificial Sequence
  source: /note="Description of Artificial Sequence: Synthetic oligonucleotide"
auucacaccauucaacuug

SEQ ID NO: 402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucacaccauucaacuugtt

SEQ ID NO: 403 - RNA, 19 nt, Artificial Sequence
  source: /note="Description of Artificial Sequence: Synthetic oligonucleotide"
caaguugaauggugugaau

SEQ ID NO: 404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaguugaauggugugaautt

SEQ ID NO: 405 - RNA, 19 nt, Artificial Sequence
  source: /note="Description of Artificial Sequence: Synthetic oligonucleotide"
acaccauucaacuugcccc

SEQ ID NO: 406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccauucaacuugcccctt

SEQ ID NO: 407 - RNA, 19 nt, Artificial Sequence
  source: /note="Description of Artificial Sequence: Synthetic oligonucleotide"
ggggcaaguugaauggugu

SEQ ID NO: 408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcaaguugaauggugutt

SEQ ID NO: 409 - RNA, 19 nt, Artificial Sequence
  source: /note="Description of Artificial Sequence: Synthetic oligonucleotide"
ucccuggugucuuaguuuc

SEQ ID NO: 410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuggugucuuaguuuctt

SEQ ID NO: 411 - RNA, 19 nt, Artificial Sequence
  source: /note="Description of Artificial Sequence: Synthetic oligonucleotide"
gaaacuaagacaccaggga

SEQ ID NO: 412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaacuaagacaccagggatt

SEQ ID NO: 413 - RNA, 19 nt, Artificial Sequence
  source: /note="Description of Artificial Sequence: Synthetic oligonucleotide"
uuccacaguaagguuugcc

SEQ ID NO: 414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccacaguaagguuugcctt

SEQ ID NO: 415 - RNA, 19 nt, Artificial Sequence
  source: /note="Description of Artificial Sequence: Synthetic oligonucleotide"
ggcaaaccuuacuguggaa

SEQ ID NO: 416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaaaccuuacuguggaatt

SEQ ID NO: 417 - RNA, 19 nt, Artificial Sequence
  source: /note="Description of Artificial Sequence: Synthetic oligonucleotide"
guuugccuguguacagacc

SEQ ID NO: 418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuugccuguguacagacctt

SEQ ID NO: 419 - RNA, 19 nt, Artificial Sequence
  source: /note="Description of Artificial Sequence: Synthetic oligonucleotide"
ggucuguacacaggcaaac

SEQ ID NO: 420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucuguacacaggcaaactt

SEQ ID NO: 421 - RNA, 19 nt, Artificial Sequence
  source: /note="Description of Artificial Sequence: Synthetic oligonucleotide"
uucaauaaauuauuggcau

SEQ ID NO: 422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaauaaauuauuggcautt

SEQ ID NO: 423 - RNA, 19 nt, Artificial Sequence
  source: /note="Description of Artificial Sequence: Synthetic oligonucleotide"
augccaauaauuuauugaa

SEQ ID NO: 424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augccaauaauuuauugaatt

SEQ ID NO: 425 - RNA, 19 nt, Artificial Sequence
  source: /note="Description of Artificial Sequence: Synthetic oligonucleotide"
aauaaauuauuggcaugaa

SEQ ID NO: 426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauaaauuauuggcaugaatt

SEQ ID NO: 427 - RNA, 19 nt, Artificial Sequence
  source: /note="Description of Artificial Sequence: Synthetic oligonucleotide"
uucaugccaauaauuuauu

SEQ ID NO: 428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaugccaauaauuuauutt

SEQ ID NO: 429 - RNA, 19 nt, Artificial Sequence
  source: /note="Description of Artificial Sequence: Synthetic oligonucleotide"
auuggcaugaaacccuuaa

SEQ ID NO: 430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuggcaugaaacccuuaatt

SEQ ID NO: 431 - RNA, 19 nt, Artificial Sequence
  source: /note="Description of Artificial Sequence: Synthetic oligonucleotide"
uuaaggguuucaugccaau

SEQ ID NO: 432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaggguuucaugccaautt

SEQ ID NO: 433 - RNA, 19 nt, Artificial Sequence
  source: /note="Description of Artificial Sequence: Synthetic oligonucleotide"
gggaaagcgucagucgggg

SEQ ID NO: 434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaaagcgucagucggggtt

SEQ ID NO: 435 - RNA, 19 nt, Artificial Sequence
  source: /note="Description of Artificial Sequence: Synthetic oligonucleotide"
ccccgacugacgcuuuccc

SEQ ID NO: 436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgacugacgcuuuccctt

SEQ ID NO: 437 - RNA, 19 nt, Artificial Sequence
  source: /note="Description of Artificial Sequence: Synthetic oligonucleotide"
auccacucccaaggugugu

SEQ ID NO: 438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccacucccaaggugugutt

SEQ ID NO: 439 - RNA, 19 nt, Artificial Sequence
  source: /note="Description of Artificial Sequence: Synthetic oligonucleotide"
acacaccuugggaguggau

SEQ ID NO: 440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacaccuugggaguggautt

SEQ ID NO: 441 - RNA, 19 nt, Artificial Sequence
  source: /note="Description of Artificial Sequence: Synthetic oligonucleotide"
agccacagauuacaccucg

SEQ ID NO: 442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccacagauuacaccucgtt

SEQ ID NO: 443 - RNA, 19 nt, Artificial Sequence
  source: /note="Description of Artificial Sequence: Synthetic oligonucleotide"
cgagguguaaucuguggcu

SEQ ID NO: 444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagguguaaucuguggcutt

SEQ ID NO: 445 - RNA, 19 nt, Artificial Sequence
  source: /note="Description of Artificial Sequence: Synthetic oligonucleotide"
ggaguacacgccauccuca

SEQ ID NO: 446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguacacgccauccucatt

SEQ ID NO: 447 - RNA, 19 nt, Artificial Sequence
  source: /note="Description of Artificial Sequence: Synthetic oligonucleotide"
ugaggauggcguguacucc

SEQ ID NO: 448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggauggcguguacucctt

SEQ ID NO: 449 - RNA, 19 nt, Artificial Sequence
  source: /note="Description of Artificial Sequence: Synthetic oligonucleotide"
gucccuuguaaauagaacc

SEQ ID NO: 450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucccuuguaaauagaacctt

SEQ ID NO: 451 - RNA, 19 nt, Artificial Sequence
  source: /note="Description of Artificial Sequence: Synthetic oligonucleotide"
gguucuauuuacaagggac

SEQ ID NO: 452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucuauuuacaagggactt

SEQ ID NO: 453 - RNA, 19 nt, Artificial Sequence
  source: /note="Description of Artificial Sequence: Synthetic oligonucleotide"
ucccuuguaaauagaacca

SEQ ID NO: 454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuuguaaauagaaccatt

SEQ ID NO: 455 - RNA, 19 nt, Artificial Sequence
  source: /note="Description of Artificial Sequence: Synthetic oligonucleotide"
ugguucuauuuacaaggga

SEQ ID NO: 456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguucuauuuacaagggatt

SEQ ID NO: 457 - RNA, 19 nt, Artificial Sequence
  source: /note="Description of Artificial Sequence: Synthetic oligonucleotide"
aguuuccacaguaagguuu

SEQ ID NO: 458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuuccacaguaagguuutt

SEQ ID NO: 459 - RNA, 19 nt, Artificial Sequence
  source: /note="Description of Artificial Sequence: Synthetic oligonucleotide"
aaaccuuacuguggaaacu

SEQ ID NO: 460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaccuuacuguggaaacutt

SEQ ID NO: 461 - RNA, 19 nt, Artificial Sequence
  source: /note="Description of Artificial Sequence: Synthetic oligonucleotide"
gaugaacccuaacuauacg

SEQ ID NO: 462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaacccuaacuauacgtt

SEQ ID NO: 463 - RNA, 19 nt, Artificial Sequence
  source: /note="Description of Artificial Sequence: Synthetic oligonucleotide"
cguauaguuaggguucauc

SEQ ID NO: 464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguauaguuaggguucauctt

SEQ ID NO: 465 - RNA, 19 nt, Artificial Sequence
  source: /note="Description of Artificial Sequence: Synthetic oligonucleotide"
agcgucagucggggcuaug

SEQ ID NO: 466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgucagucggggcuaugtt

SEQ ID NO: 467 - RNA, 19 nt, Artificial Sequence
  source: /note="Description of Artificial Sequence: Synthetic oligonucleotide"
cauagccccgacugacgcu

SEQ ID NO: 468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauagccccgacugacgcutt

SEQ ID NO: 469 - RNA, 19 nt, Artificial Sequence
  source: /note="Description of Artificial Sequence: Synthetic oligonucleotide"
gcucauucggaguaguaua

SEQ ID NO: 470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucauucggaguaguauatt

SEQ ID NO: 471 - RNA, 19 nt, Artificial Sequence
  source: /note="Description of Artificial Sequence: Synthetic oligonucleotide"
uauacuacuccgaaugagc

SEQ ID NO: 472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacuacuccgaaugagctt

SEQ ID NO: 473 - RNA, 19 nt, Artificial Sequence
  source: /note="Description of Artificial Sequence: Synthetic oligonucleotide"
auucggaguaguauaccag

SEQ ID NO: 474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucggaguaguauaccagtt

SEQ ID NO: 475 - RNA, 19 nt, Artificial Sequence
  source: /note="Description of Artificial Sequence: Synthetic oligonucleotide"
cugguauacuacuccgaau

SEQ ID NO: 476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguauacuacuccgaautt

SEQ ID NO: 477 - RNA, 19 nt, Artificial Sequence
  source: /note="Description of Artificial Sequence: Synthetic oligonucleotide"
cugcagauuaugcguaagc

SEQ ID NO: 478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcagauuaugcguaagctt

SEQ ID NO: 479 - RNA, 19 nt, Artificial Sequence
  source: /note="Description of Artificial Sequence: Synthetic oligonucleotide"
gcuuacgcauaaucugcag

SEQ ID NO: 480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuacgcauaaucugcagtt

SEQ ID NO: 481 - RNA, 19 nt, Artificial Sequence
  source: /note="Description of Artificial Sequence: Synthetic oligonucleotide"
ugcagauuaugcguaagcu

SEQ ID NO: 482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagauuaugcguaagcutt

SEQ ID NO: 483 - RNA, 19 nt, Artificial Sequence
  source: /note="Description of Artificial Sequence: Synthetic oligonucleotide"
agcuuacgcauaaucugca

SEQ ID NO: 484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuacgcauaaucugcatt

SEQ ID NO: 485 - RNA, 19 nt, Artificial Sequence
  source: /note="Description of Artificial Sequence: Synthetic oligonucleotide"
gcagauuaugcguaagcug

SEQ ID NO: 486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagauuaugcguaagcugtt

SEQ ID NO: 487 - RNA, 19 nt, Artificial Sequence
  source: /note="Description of Artificial Sequence: Synthetic oligonucleotide"
cagcuuacgcauaaucugc

SEQ ID NO: 488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuuacgcauaaucugctt

SEQ ID NO: 489 - RNA, 19 nt, Artificial Sequence
  source: /note="Description of Artificial Sequence: Synthetic oligonucleotide"
ccccaacgaccgcccgcuu

SEQ ID NO: 490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccaacgaccgcccgcuutt

SEQ ID NO: 491 - RNA, 19 nt, Artificial Sequence
  source: /note="Description of Artificial Sequence: Synthetic oligonucleotide"
aagcgggcggucguugggg

SEQ ID NO: 492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcgggcggucguuggggtt

SEQ ID NO: 493 - RNA, 19 nt, Artificial Sequence
  source: /note="Description of Artificial Sequence: Synthetic oligonucleotide"
cccaacgaccgcccgcuuc

SEQ ID NO: 494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaacgaccgcccgcuuctt

SEQ ID NO: 495 - RNA, 19 nt, Artificial Sequence
  source: /note="Description of Artificial Sequence: Synthetic oligonucleotide"
gaagcgggcggucguuggg

SEQ ID NO: 496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcgggcggucguugggtt

SEQ ID NO: 497 - RNA, 19 nt, Artificial Sequence
  source: /note="Description of Artificial Sequence: Synthetic oligonucleotide"
ugcuacccucgcuagcucu

SEQ ID NO: 498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuacccucgcuagcucutt

SEQ ID NO: 499 - RNA, 19 nt, Artificial Sequence
  source: /note="Description of Artificial Sequence: Synthetic oligonucleotide"
agagcuagcgaggguagca

SEQ ID NO: 500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcuagcgaggguagcatt

SEQ ID NO: 501 - RNA, 19 nt, Artificial Sequence
  source: /note="Description of Artificial Sequence: Synthetic oligonucleotide"
gggagugaagcugggccgu

SEQ ID NO: 502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagugaagcugggccgutt

SEQ ID NO: 503 - RNA, 19 nt, Artificial Sequence
  source: /note="Description of Artificial Sequence: Synthetic oligonucleotide"
acggcccagcuucacuccc

SEQ ID NO: 504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggcccagcuucacuccctt

SEQ ID NO: 505 - RNA, 19 nt, Artificial Sequence
  source: /note="Description of Artificial Sequence: Synthetic oligonucleotide"
ggagugaagcugggccgug

SEQ ID NO: 506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagugaagcugggccgugtt

SEQ ID NO: 507 - RNA, 19 nt, Artificial Sequence
  source: /note="Description of Artificial Sequence: Synthetic oligonucleotide"
cacggcccagcuucacucc

SEQ ID NO: 508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacggcccagcuucacucctt

SEQ ID NO: 509 - RNA, 19 nt, Artificial Sequence
  source: /note="Description of Artificial Sequence: Synthetic oligonucleotide"
ggcucauucggaguaguau

SEQ ID NO: 510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucauucggaguaguautt

SEQ ID NO: 511 - RNA, 19 nt, Artificial Sequence
  source: /note="Description of Artificial Sequence: Synthetic oligonucleotide"
auacuacuccgaaugagcc

SEQ ID NO: 512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacuacuccgaaugagcctt

SEQ ID NO: 513 - RNA, 19 nt, Artificial Sequence
  source: /note="Description of Artificial Sequence: Synthetic oligonucleotide"
cucauucggaguaguauac

SEQ ID NO: 514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucauucggaguaguauactt

SEQ ID NO: 515 - RNA, 19 nt, Artificial Sequence
  source: /note="Description of Artificial Sequence: Synthetic oligonucleotide"
guauacuacuccgaaugag

SEQ ID NO: 516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauacuacuccgaaugagtt

SEQ ID NO: 517 - RNA, 19 nt, Artificial Sequence
  source: /note="Description of Artificial Sequence: Synthetic oligonucleotide"
ucauucggaguaguauacc

SEQ ID NO: 518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauucggaguaguauacctt

SEQ ID NO: 519 - RNA, 19 nt, Artificial Sequence
  source: /note="Description of Artificial Sequence: Synthetic oligonucleotide"
gguauacuacuccgaauga

SEQ ID NO: 520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguauacuacuccgaaugatt

SEQ ID NO: 521 - RNA, 19 nt, Artificial Sequence
  source: /note="Description of Artificial Sequence: Synthetic oligonucleotide"
cauucggaguaguauacca

SEQ ID NO: 522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauucggaguaguauaccatt

SEQ ID NO: 523 - RNA, 19 nt, Artificial Sequence
  source: /note="Description of Artificial Sequence: Synthetic oligonucleotide"
ugguauacuacuccgaaug

SEQ ID NO: 524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguauacuacuccgaaugtt

SEQ ID NO: 525 - RNA, 19 nt, Artificial Sequence
  source: /note="Description of Artificial Sequence: Synthetic oligonucleotide"
uucggaguaguauaccagg

SEQ ID NO: 526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucggaguaguauaccaggtt

SEQ ID NO: 527 - RNA, 19 nt, Artificial Sequence
  source: /note="Description of Artificial Sequence: Synthetic oligonucleotide"
ccugguauacuacuccgaa

SEQ ID NO: 528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugguauacuacuccgaatt

SEQ ID NO: 529 - RNA, 19 nt, Artificial Sequence
  source: /note="Description of Artificial Sequence: Synthetic oligonucleotide"
acugcagauuaugcguaag

SEQ ID NO: 530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcagauuaugcguaagtt

SEQ ID NO: 531 - RNA, 19 nt, Artificial Sequence
  source: /note="Description of Artificial Sequence: Synthetic oligonucleotide"
cuuacgcauaaucugcagu

SEQ ID NO: 532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuacgcauaaucugcagutt

SEQ ID NO: 533 - RNA, 19 nt, Artificial Sequence
  source: /note="Description of Artificial Sequence: Synthetic oligonucleotide"
cccgagacgguguaccgag

SEQ ID NO: 534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgagacgguguaccgagtt

SEQ ID NO: 535 - RNA, 19 nt, Artificial Sequence
  source: /note="Description of Artificial Sequence: Synthetic oligonucleotide"
cucgguacaccgucucggg

SEQ ID NO: 536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgguacaccgucucgggtt

SEQ ID NO: 537 - RNA, 19 nt, Artificial Sequence
  source: /note="Description of Artificial Sequence: Synthetic oligonucleotide"
ccgagacgguguaccgagu

SEQ ID NO: 538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagacgguguaccgagutt

SEQ ID NO: 539 - RNA, 19 nt, Artificial Sequence
  source: /note="Description of Artificial Sequence: Synthetic oligonucleotide"
acucgguacaccgucucgg

SEQ ID NO: 540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucgguacaccgucucggtt

SEQ ID NO: 541 - RNA, 19 nt, Artificial Sequence
  source: /note="Description of Artificial Sequence: Synthetic oligonucleotide"
gagacgguguaccgagugg

SEQ ID NO: 542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagacgguguaccgaguggtt

SEQ ID NO: 543 - RNA, 19 nt, Artificial Sequence
  source: /note="Description of Artificial Sequence: Synthetic oligonucleotide"
ccacucgguacaccgucuc

SEQ ID NO: 544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacucgguacaccgucuctt

SEQ ID NO: 545 - RNA, 19 nt, Artificial Sequence
  source: /note="Description of Artificial Sequence: Synthetic oligonucleotide"
uuuggagccacagauuaca

SEQ ID NO: 546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggagccacagauuacatt

SEQ ID NO: 547 - RNA, 19 nt, Artificial Sequence
  source: /note="Description of Artificial Sequence: Synthetic oligonucleotide"
uguaaucuguggcuccaaa

SEQ ID NO: 548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaaucuguggcuccaaatt

SEQ ID NO: 549 - RNA, 19 nt, Artificial Sequence
  source: /note="Description of Artificial Sequence: Synthetic oligonucleotide"
agagaugaacccuaacuau

SEQ ID NO: 550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagaugaacccuaacuautt

SEQ ID NO: 551 - RNA, 19 nt, Artificial Sequence
  source: /note="Description of Artificial Sequence: Synthetic oligonucleotide"
auaguuaggguucaucucu

SEQ ID NO: 552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaguuaggguucaucucutt

SEQ ID NO: 553 - RNA, 19 nt, Artificial Sequence
  source: /note="Description of Artificial Sequence: Synthetic oligonucleotide"
agaugaacccuaacuauac

SEQ ID NO: 554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugaacccuaacuauactt

SEQ ID NO: 555 - RNA, 19 nt, Artificial Sequence
  source: /note="Description of Artificial Sequence: Synthetic oligonucleotide"
guauaguuaggguucaucu

SEQ ID NO: 556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauaguuaggguucaucutt

SEQ ID NO: 557 - RNA, 19 nt, Artificial Sequence
  source: /note="Description of Artificial Sequence: Synthetic oligonucleotide"
caacugcuacccucgcuag

SEQ ID NO: 558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacugcuacccucgcuagtt

SEQ ID NO: 559 - RNA, 19 nt, Artificial Sequence
  source: /note="Description of Artificial Sequence: Synthetic oligonucleotide"
cuagcgaggguagcaguug

SEQ ID NO: 560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagcgaggguagcaguugtt

SEQ ID NO: 561 - RNA, 19 nt, Artificial Sequence
  source: /note="Description of Artificial Sequence: Synthetic oligonucleotide"
cugcuacccucgcuagcuc

SEQ ID NO: 562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuacccucgcuagcuctt

SEQ ID NO: 563 - RNA, 19 nt, Artificial Sequence
  source: /note="Description of Artificial Sequence: Synthetic oligonucleotide"
gagcuagcgaggguagcag

SEQ ID NO: 564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuagcgaggguagcagtt

SEQ ID NO: 565 - RNA, 19 nt, Artificial Sequence
  source: /note="Description of Artificial Sequence: Synthetic oligonucleotide"
guguaaauagauuguuaua

SEQ ID NO: 566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguaaauagauuguuauatt

SEQ ID NO: 567 - RNA, 19 nt, Artificial Sequence
  source: /note="Description of Artificial Sequence: Synthetic oligonucleotide"
uauaacaaucuauuuacac

SEQ ID NO: 568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaacaaucuauuuacactt

SEQ ID NO: 569 - RNA, 19 nt, Artificial Sequence
  source: /note="Description of Artificial Sequence: Synthetic oligonucleotide"
ggccccggcgcgggcacua

SEQ ID NO: 570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccggcgcgggcacuatt

SEQ ID NO: 571 - RNA, 19 nt, Artificial Sequence
  source: /note="Description of Artificial Sequence: Synthetic oligonucleotide"
uagugcccgcgccggggcc

SEQ ID NO: 572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagugcccgcgccggggcctt

SEQ ID NO: 573 - RNA, 19 nt, Artificial Sequence
  source: /note="Description of Artificial Sequence: Synthetic oligonucleotide"
gcuuggccuacauccacuc

SEQ ID NO: 574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuggccuacauccacuctt

SEQ ID NO: 575 - RNA, 19 nt, Artificial Sequence
  source: /note="Description of Artificial Sequence: Synthetic oligonucleotide"
gaguggauguaggccaagc

SEQ ID NO: 576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguggauguaggccaagctt

SEQ ID NO: 577 - RNA, 19 nt, Artificial Sequence
  source: /note="Description of Artificial Sequence: Synthetic oligonucleotide"
gagaugaacccuaacuaua

SEQ ID NO: 578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaugaacccuaacuauatt

SEQ ID NO: 579 - RNA, 19 nt, Artificial Sequence
  source: /note="Description of Artificial Sequence: Synthetic oligonucleotide"
uauaguuaggguucaucuc

SEQ ID NO: 580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaguuaggguucaucuctt

SEQ ID NO: 581 - RNA, 19 nt, Artificial Sequence
  source: /note="Description of Artificial Sequence: Synthetic oligonucleotide"
ucuccccacucgaggcuug

SEQ ID NO: 582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccccacucgaggcuugtt

SEQ ID NO: 583 - RNA, 19 nt, Artificial Sequence
  source: /note="Description of Artificial Sequence: Synthetic oligonucleotide"
caagccucgaguggggaga

SEQ ID NO: 584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagccucgaguggggagatt

SEQ ID NO: 585 - RNA, 19 nt, Artificial Sequence
  source: /note="Description of Artificial Sequence: Synthetic oligonucleotide"
acagcuucuucgaugaacu

SEQ ID NO: 586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcuucuucgaugaacutt

SEQ ID NO: 587 - RNA, 19 nt, Artificial Sequence
  source: /note="Description of Artificial Sequence: Synthetic oligonucleotide"
aguucaucgaagaagcugu

SEQ ID NO: 588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucaucgaagaagcugutt

SEQ ID NO: 589 - RNA, 19 nt, Artificial Sequence
  source: /note="Description of Artificial Sequence: Synthetic oligonucleotide"
cuccccaacgaccgcccgc

SEQ ID NO: 590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccaacgaccgcccgctt

SEQ ID NO: 591 - RNA, 19 nt, Artificial Sequence
  source: /note="Description of Artificial Sequence: Synthetic oligonucleotide"
gcgggcggucguuggggag

SEQ ID NO: 592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggcggucguuggggagtt

SEQ ID NO: 593 - RNA, 19 nt, Artificial Sequence
  source: /note="Description of Artificial Sequence: Synthetic oligonucleotide"
caacgaccgcccgcuuccc

SEQ ID NO: 594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacgaccgcccgcuuccctt

SEQ ID NO: 595 - RNA, 19 nt, Artificial Sequence
  source: /note="Description of Artificial Sequence: Synthetic oligonucleotide"
gggaagcgggcggucguug

SEQ ID NO: 596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagcgggcggucguugtt

SEQ ID NO: 597 - RNA, 19 nt, Artificial Sequence
  source: /note="Description of Artificial Sequence: Synthetic oligonucleotide"
aacgaccgcccgcuucccc

SEQ ID NO: 598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgaccgcccgcuucccctt

SEQ ID NO: 599 - RNA, 19 nt, Artificial Sequence
  source: /note="Description of Artificial Sequence: Synthetic oligonucleotide"
ggggaagcgggcggucguu

SEQ ID NO: 600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaagcgggcggucguutt

SEQ ID NO: 601 - RNA, 19 nt, Artificial Sequence
  source: /note="Description of Artificial Sequence: Synthetic oligonucleotide"
gagagucccuggugucuua

SEQ ID NO: 602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagucccuggugucuuatt

SEQ ID NO: 603 - RNA, 19 nt, Artificial Sequence
  source: /note="Description of Artificial Sequence: Synthetic oligonucleotide"
uaagacaccagggacucuc

SEQ ID NO: 604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagacaccagggacucuctt

SEQ ID NO: 605 - RNA, 19 nt, Artificial Sequence
  source: /note="Description of Artificial Sequence: Synthetic oligonucleotide"
acggcuggcagagacgagg

SEQ ID NO: 606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggcuggcagagacgaggtt

SEQ ID NO: 607 - RNA, 19 nt, Artificial Sequence
  source: /note="Description of Artificial Sequence: Synthetic oligonucleotide"
ccucgucucugccagccgu

SEQ ID NO: 608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucgucucugccagccgutt

SEQ ID NO: 609 - RNA, 19 nt, Artificial Sequence
  source: /note="Description of Artificial Sequence: Synthetic oligonucleotide"
uugugaggcugcgguacuu

SEQ ID NO: 610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugugaggcugcgguacuutt

SEQ ID NO: 611 - RNA, 19 nt, Artificial Sequence
  source: /note="Description of Artificial Sequence: Synthetic oligonucleotide"
aaguaccgcagccucacaa

SEQ ID NO: 612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguaccgcagccucacaatt

SEQ ID NO: 613 - RNA, 19 nt, Artificial Sequence
  source: /note="Description of Artificial Sequence: Synthetic oligonucleotide"
ugugaggcugcgguacuuu

SEQ ID NO: 614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugaggcugcgguacuuutt

SEQ ID NO: 615 - RNA, 19 nt, Artificial Sequence
  source: /note="Description of Artificial Sequence: Synthetic oligonucleotide"
aaaguaccgcagccucaca

SEQ ID NO: 616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaguaccgcagccucacatt

SEQ ID NO: 617 - RNA, 19 nt, Artificial Sequence
  source: /note="Description of Artificial Sequence: Synthetic oligonucleotide"
gacgguguaccgaguggcc

SEQ ID NO: 618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgguguaccgaguggcctt

SEQ ID NO: 619 - RNA, 19 nt, Artificial Sequence
  source: /note="Description of Artificial Sequence: Synthetic oligonucleotide"
ggccacucgguacaccguc

SEQ ID NO: 620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccacucgguacaccguctt

SEQ ID NO: 621 - RNA, 19 nt, Artificial Sequence
  source: /note="Description of Artificial Sequence: Synthetic oligonucleotide"
cucccaaggugugugucac

SEQ ID NO: 622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccaaggugugugucactt

SEQ ID NO: 623 - RNA, 19 nt, Artificial Sequence
  source: /note="Description of Artificial Sequence: Synthetic oligonucleotide"
gugacacacaccuugggag

SEQ ID NO: 624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugacacacaccuugggagtt

SEQ ID NO: 625 - RNA, 19 nt, Artificial Sequence
  source: /note="Description of Artificial Sequence: Synthetic oligonucleotide"
ugcaaagcagcugguucgg

SEQ ID NO: 626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaaagcagcugguucggtt

SEQ ID NO: 627 - RNA, 19 nt, Artificial Sequence
  source: /note="Description of Artificial Sequence: Synthetic oligonucleotide"
ccgaaccagcugcuuugca

SEQ ID NO: 628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaaccagcugcuuugcatt

SEQ ID NO: 629 - RNA, 19 nt, Artificial Sequence
  source: /note="Description of Artificial Sequence: Synthetic oligonucleotide"
cuuuggagccacagauuac

SEQ ID NO: 630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuggagccacagauuactt

SEQ ID NO: 631 - RNA, 19 nt, Artificial Sequence
  source: /note="Description of Artificial Sequence: Synthetic oligonucleotide"
guaaucuguggcuccaaag

SEQ ID NO: 632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaucuguggcuccaaagtt

SEQ ID NO: 633 - RNA, 19 nt, Artificial Sequence
  source: /note="Description of Artificial Sequence: Synthetic oligonucleotide"
uuggagccacagauuacac

SEQ ID NO: 634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggagccacagauuacactt

SEQ ID NO: 635 - RNA, 19 nt, Artificial Sequence
  source: /note="Description of Artificial Sequence: Synthetic oligonucleotide"
guguaaucuguggcuccaa

SEQ ID NO: 636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguaaucuguggcuccaatt

SEQ ID NO: 637 - RNA, 19 nt, Artificial Sequence
  source: /note="Description of Artificial Sequence: Synthetic oligonucleotide"
gagcuacuucucggccagc

SEQ ID NO: 638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuacuucucggccagctt

SEQ ID NO: 639 - RNA, 19 nt, Artificial Sequence
  source: /note="Description of Artificial Sequence: Synthetic oligonucleotide"
gcuggccgagaaguagcuc

SEQ ID NO: 640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggccgagaaguagcuctt

SEQ ID NO: 641 - RNA, 19 nt, Artificial Sequence
  source: /note="Description of Artificial Sequence: Synthetic oligonucleotide"
gagagaugaacccuaacua

SEQ ID NO: 642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagaugaacccuaacuatt

SEQ ID NO: 643 - RNA, 19 nt, Artificial Sequence
  source: /note="Description of Artificial Sequence: Synthetic oligonucleotide"
uaguuaggguucaucucuc

SEQ ID NO: 644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguuaggguucaucucuctt

SEQ ID NO: 645 - RNA, 19 nt, Artificial Sequence
  source: /note="Description of Artificial Sequence: Synthetic oligonucleotide"
gaucaaagcucacccuugg

SEQ ID NO: 646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaaagcucacccuuggtt

SEQ ID NO: 647 - RNA, 19 nt, Artificial Sequence
  source: /note="Description of Artificial Sequence: Synthetic oligonucleotide"
ccaagggugagcuuugauc

SEQ ID NO: 648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagggugagcuuugauctt

SEQ ID NO: 649 - RNA, 19 nt, Artificial Sequence
  source: /note="Description of Artificial Sequence: Synthetic oligonucleotide"
aaagcucacccuuggacaa

SEQ ID NO: 650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcucacccuuggacaatt

SEQ ID NO: 651 - RNA, 19 nt, Artificial Sequence
  source: /note="Description of Artificial Sequence: Synthetic oligonucleotide"
uuguccaagggugagcuuu

SEQ ID NO: 652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccaagggugagcuuutt

SEQ ID NO: 653 - RNA, 19 nt, Artificial Sequence
  source: /note="Description of Artificial Sequence: Synthetic oligonucleotide"
aggcucuccccacucgagg

SEQ ID NO: 654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcucuccccacucgaggtt

SEQ ID NO: 655 - RNA, 19 nt, Artificial Sequence
  source: /note="Description of Artificial Sequence: Synthetic oligonucleotide"
ccucgaguggggagagccu

SEQ ID NO: 656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucgaguggggagagccutt

SEQ ID NO: 657 - RNA, 19 nt, Artificial Sequence
  source: /note="Description of Artificial Sequence: Synthetic oligonucleotide"
acuguccauccaaccaucu

SEQ ID NO: 658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguccauccaaccaucutt

SEQ ID NO: 659 - RNA, 19 nt, Artificial Sequence
  source: /note="Description of Artificial Sequence: Synthetic oligonucleotide"
agaugguuggauggacagu

SEQ ID NO: 660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugguuggauggacagutt

SEQ ID NO: 661 - RNA, 19 nt, Artificial Sequence
  source: /note="Description of Artificial Sequence: Synthetic oligonucleotide"
aacugcuacccucgcuagc

SEQ ID NO: 662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugcuacccucgcuagctt

SEQ ID NO: 663 - RNA, 19 nt, Artificial Sequence
  source: /note="Description of Artificial Sequence: Synthetic oligonucleotide"
gcuagcgaggguagcaguu

SEQ ID NO: 664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagcgaggguagcaguutt

SEQ ID NO: 665 - RNA, 19 nt, Artificial Sequence
  source: /note="Description of Artificial Sequence: Synthetic oligonucleotide"
ccuuguaaauagaaccagc

SEQ ID NO: 666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuguaaauagaaccagctt

SEQ ID NO: 667 - RNA, 19 nt, Artificial Sequence
  source: /note="Description of Artificial Sequence: Synthetic oligonucleotide"
gcugguucuauuuacaagg

SEQ ID NO: 668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguucuauuuacaaggtt

SEQ ID NO: 669 - RNA, 19 nt, Artificial Sequence
  source: /note="Description of Artificial Sequence: Synthetic oligonucleotide"
uuuccacaguaagguuugc

SEQ ID NO: 670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuccacaguaagguuugctt

SEQ ID NO: 671 - RNA, 19 nt, Artificial Sequence
  source: /note="Description of Artificial Sequence: Synthetic oligonucleotide"
gcaaaccuuacuguggaaa

SEQ ID NO: 672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaaccuuacuguggaaatt

SEQ ID NO: 673 - RNA, 19 nt, Artificial Sequence
  source: /note="Description of Artificial Sequence: Synthetic oligonucleotide"
cccuuguaaauagaaccag

SEQ ID NO: 674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuuguaaauagaaccagtt

SEQ ID NO: 675 - RNA, 19 nt, Artificial Sequence
  source: /note="Description of Artificial Sequence: Synthetic oligonucleotide"
cugguucuauuuacaaggg

SEQ ID NO: 676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguucuauuuacaagggtt

SEQ ID NO: 677 - RNA, 19 nt, Artificial Sequence
  source: /note="Description of Artificial Sequence: Synthetic oligonucleotide"
aaaagguucaagaaccgag

SEQ ID NO: 678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaagguucaagaaccgagtt

SEQ ID NO: 679 - RNA, 19 nt, Artificial Sequence
  source: /note="Description of Artificial Sequence: Synthetic oligonucleotide"
cucgguucuugaaccuuuu

SEQ ID NO: 680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgguucuugaaccuuuutt

SEQ ID NO: 681 - RNA, 19 nt, Artificial Sequence
  source: /note="Description of Artificial Sequence: Synthetic oligonucleotide"
aauauugugaggcugcggu

SEQ ID NO: 682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauauugugaggcugcggutt

SEQ ID NO: 683 - RNA, 19 nt, Artificial Sequence
  source: /note="Description of Artificial Sequence: Synthetic oligonucleotide"
accgcagccucacaauauu

SEQ ID NO: 684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcagccucacaauauutt

SEQ ID NO: 685 - RNA, 19 nt, Artificial Sequence
  source: /note="Description of Artificial Sequence: Synthetic oligonucleotide"
caaggcucuccccacucga

SEQ ID NO: 686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggcucuccccacucgatt

SEQ ID NO: 687 - RNA, 19 nt, Artificial Sequence
  source: /note="Description of Artificial Sequence: Synthetic oligonucleotide"
ucgaguggggagagccuug

SEQ ID NO: 688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaguggggagagccuugtt

SEQ ID NO: 689 - RNA, 19 nt, Artificial Sequence
  source: /note="Description of Artificial Sequence: Synthetic oligonucleotide"
caauauugugaggcugcgg

SEQ ID NO: 690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauauugugaggcugcggtt

SEQ ID NO: 691 - RNA, 19 nt, Artificial Sequence
  source: /note="Description of Artificial Sequence: Synthetic oligonucleotide"
ccgcagccucacaauauug

SEQ ID NO: 692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcagccucacaauauugtt

SEQ ID NO: 693 - RNA, 19 nt, Artificial Sequence
  source: /note="Description of Artificial Sequence: Synthetic oligonucleotide"
cuaacuauacggaguucaa

SEQ ID NO: 694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaacuauacggaguucaatt

SEQ ID NO: 695 - RNA, 19 nt, Artificial Sequence
  source: /note="Description of Artificial Sequence: Synthetic oligonucleotide"
uugaacuccguauaguuag

SEQ ID NO: 696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaacuccguauaguuagtt

SEQ ID NO: 697 - RNA, 19 nt, Artificial Sequence
  source: /note="Description of Artificial Sequence: Synthetic oligonucleotide"
uaaagaaaacgucaauuca

SEQ ID NO: 698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaagaaaacgucaauucatt

SEQ ID NO: 699 - RNA, 19 nt, Artificial Sequence
  source: /note="Description of Artificial Sequence: Synthetic oligonucleotide"
ugaauugacguuuucuuua

SEQ ID NO: 700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaauugacguuuucuuuatt

SEQ ID NO: 701 - RNA, 19 nt, Artificial Sequence
  source: /note="Description of Artificial Sequence: Synthetic oligonucleotide"
aagcugaucaccccuauca

SEQ ID NO: 702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcugaucaccccuaucatt

SEQ ID NO: 703 - RNA, 19 nt, Artificial Sequence
  source: /note="Description of Artificial Sequence: Synthetic oligonucleotide"
ugauaggggugaucagcuu

SEQ ID NO: 704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauaggggugaucagcuutt

SEQ ID NO: 705 - RNA, 19 nt, Artificial Sequence
  source: /note="Description of Artificial Sequence: Synthetic oligonucleotide"
ccccagaauuugcuugugg

SEQ ID NO: 706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagaauuugcuuguggtt

SEQ ID NO: 707 - RNA, 19 nt, Artificial Sequence
  source: /note="Description of Artificial Sequence: Synthetic oligonucleotide"
ccacaagcaaauucugggg

SEQ ID NO: 708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaagcaaauucuggggtt

SEQ ID NO: 709 - RNA, 19 nt, Artificial Sequence
  source: /note="Description of Artificial Sequence: Synthetic oligonucleotide"
gcagcugguucggggggag

SEQ ID NO: 710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcugguucggggggagtt

SEQ ID NO: 711 - RNA, 19 nt, Artificial Sequence
  source: /note="Description of Artificial Sequence: Synthetic oligonucleotide"
cuccccccgaaccagcugc

SEQ ID NO: 712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccccgaaccagcugctt

SEQ ID NO: 713 - RNA, 19 nt, Artificial Sequence
  source: /note="Description of Artificial Sequence: Synthetic oligonucleotide"
ugaacuguccauccaacca

SEQ ID NO: 714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacuguccauccaaccatt

SEQ ID NO: 715 - RNA, 19 nt, Artificial Sequence
  source: /note="Description of Artificial Sequence: Synthetic oligonucleotide"
ugguuggauggacaguuca

SEQ ID NO: 716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguuggauggacaguucatt

SEQ ID NO: 717 - RNA, 19 nt, Artificial Sequence
  source: /note="Description of Artificial Sequence: Synthetic oligonucleotide"
gacuggccaagauuggcag

SEQ ID NO: 718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuggccaagauuggcagtt

SEQ ID NO: 719 - RNA, 19 nt, Artificial Sequence
  source: /note="Description of Artificial Sequence: Synthetic oligonucleotide"
cugccaaucuuggccaguc

SEQ ID NO: 720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccaaucuuggccaguctt

SEQ ID NO: 721 - RNA, 19 nt, Artificial Sequence
  source: /note="Description of Artificial Sequence: Synthetic oligonucleotide"
cucccucagcagccuaacc

SEQ ID NO: 722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccucagcagccuaacctt

SEQ ID NO: 723 - RNA, 19 nt, Artificial Sequence
  source: /note="Description of Artificial Sequence: Synthetic oligonucleotide"
gguuaggcugcugagggag

SEQ ID NO: 724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuaggcugcugagggagtt

SEQ ID NO: 725 - RNA, 19 nt, Artificial Sequence
  source: /note="Description of Artificial Sequence: Synthetic oligonucleotide"
agagucccuggugucuuag

SEQ ID NO: 726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagucccuggugucuuagtt

SEQ ID NO: 727 - RNA, 19 nt, Artificial Sequence
  source: /note="Description of Artificial Sequence: Synthetic oligonucleotide"
cuaagacaccagggacucu

SEQ ID NO: 728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaagacaccagggacucutt

SEQ ID NO: 729 - RNA, 19 nt, Artificial Sequence
  source: /note="Description of Artificial Sequence: Synthetic oligonucleotide"
gaacggcgcggccuggaag

SEQ ID NO: 730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacggcgcggccuggaagtt

SEQ ID NO: 731 - RNA, 19 nt, Artificial Sequence
  source: /note="Description of Artificial Sequence: Synthetic oligonucleotide"
cuuccaggccgcgccguuc

SEQ ID NO: 732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccaggccgcgccguuctt

SEQ ID NO: 733 - RNA, 19 nt, Artificial Sequence
  source: /note="Description of Artificial Sequence: Synthetic oligonucleotide"
gauuacaccucguccaucg

SEQ ID NO: 734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuacaccucguccaucgtt

SEQ ID NO: 735 - RNA, 19 nt, Artificial Sequence
  source: /note="Description of Artificial Sequence: Synthetic oligonucleotide"
cgauggacgagguguaauc

SEQ ID NO: 736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgauggacgagguguaauctt

SEQ ID NO: 737 - RNA, 19 nt, Artificial Sequence
  source: /note="Description of Artificial Sequence: Synthetic oligonucleotide"
uaacuauacggaguucaag

SEQ ID NO: 738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacuauacggaguucaagtt

SEQ ID NO: 739 - RNA, 19 nt, Artificial Sequence
  source: /note="Description of Artificial Sequence: Synthetic oligonucleotide"
cuugaacuccguauaguua

SEQ ID NO: 740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaacuccguauaguuatt

SEQ ID NO: 741 - RNA, 19 nt, Artificial Sequence
  source: /note="Description of Artificial Sequence: Synthetic oligonucleotide"
cagcucguucgcggagcca

SEQ ID NO: 742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcucguucgcggagccatt

SEQ ID NO: 743 - RNA, 19 nt, Artificial Sequence
  source: /note="Description of Artificial Sequence: Synthetic oligonucleotide"
uggcuccgcgaacgagcug

SEQ ID NO: 744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuccgcgaacgagcugtt

SEQ ID NO: 745 - RNA, 19 nt, Artificial Sequence
  source: /note="Description of Artificial Sequence: Synthetic oligonucleotide"
gcucguucgcggagccagg

SEQ ID NO: 746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucguucgcggagccaggtt

SEQ ID NO: 747 - RNA, 19 nt, Artificial Sequence
  source: /note="Description of Artificial Sequence: Synthetic oligonucleotide"
ccuggcuccgcgaacgagc

SEQ ID NO: 748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggcuccgcgaacgagctt

SEQ ID NO: 749 - RNA, 19 nt, Artificial Sequence
  source: /note="Description of Artificial Sequence: Synthetic oligonucleotide"
acuggcggcgggaaagcgu

SEQ ID NO: 750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggcggcgggaaagcgutt

SEQ ID NO: 751 - RNA, 19 nt, Artificial Sequence
  source: /note="Description of Artificial Sequence: Synthetic oligonucleotide"
acgcuuucccgccgccagu

SEQ ID NO: 752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgcuuucccgccgccagutt

SEQ ID NO: 753 - RNA, 19 nt, Artificial Sequence
  source: /note="Description of Artificial Sequence: Synthetic oligonucleotide"
cggcgggaaagcgucaguc

SEQ ID NO: 754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgggaaagcgucaguctt

SEQ ID NO: 755 - RNA, 19 nt, Artificial Sequence
  source: /note="Description of Artificial Sequence: Synthetic oligonucleotide"
gacugacgcuuucccgccg

SEQ ID NO: 756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacugacgcuuucccgccgtt

SEQ ID NO: 757 - RNA, 19 nt, Artificial Sequence
  source: /note="Description of Artificial Sequence: Synthetic oligonucleotide"
ccucgagcuccgggggugg

SEQ ID NO: 758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucgagcuccggggguggtt

SEQ ID NO: 759 - RNA, 19 nt, Artificial Sequence
  source: /note="Description of Artificial Sequence: Synthetic oligonucleotide"
ccacccccggagcucgagg

SEQ ID NO: 760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacccccggagcucgaggtt

SEQ ID NO: 761 - RNA, 19 nt, Artificial Sequence
  source: /note="Description of Artificial Sequence: Synthetic oligonucleotide"
cugggccgugacagcggga

SEQ ID NO: 762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccgugacagcgggatt

SEQ ID NO: 763 - RNA, 19 nt, Artificial Sequence
  source: /note="Description of Artificial Sequence: Synthetic oligonucleotide"
ucccgcugucacggcccag

SEQ ID NO: 764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccgcugucacggcccagtt

SEQ ID NO: 765 - RNA, 19 nt, Artificial Sequence
  source: /note="Description of Artificial Sequence: Synthetic oligonucleotide"
aguaguauaccaggcacgg

SEQ ID NO: 766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaguauaccaggcacggtt

SEQ ID NO: 767 - RNA, 19 nt, Artificial Sequence
  source: /note="Description of Artificial Sequence: Synthetic oligonucleotide"
ccgugccugguauacuacu

SEQ ID NO: 768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgugccugguauacuacutt

SEQ ID NO: 769 - RNA, 19 nt, Artificial Sequence
  source: /note="Description of Artificial Sequence: Synthetic oligonucleotide"
gcccgagacgguguaccga

SEQ ID NO: 770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgagacgguguaccgatt

SEQ ID NO: 771 - RNA, 19 nt, Artificial Sequence
  source: /note="Description of Artificial Sequence: Synthetic oligonucleotide"
ucgguacaccgucucgggc

SEQ ID NO: 772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguacaccgucucgggctt

SEQ ID NO: 773 - RNA, 19 nt, Artificial Sequence
  source: /note="Description of Artificial Sequence: Synthetic oligonucleotide"
ggagcccaauguguccuac

SEQ ID NO: 774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcccaauguguccuactt

SEQ ID NO: 775 - RNA, 19 nt, Artificial Sequence
  source: /note="Description of Artificial Sequence: Synthetic oligonucleotide"
guaggacacauugggcucc

SEQ ID NO: 776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggacacauugggcucctt

SEQ ID NO: 777 - RNA, 19 nt, Artificial Sequence
  source: /note="Description of Artificial Sequence: Synthetic oligonucleotide"
gagcccaauguguccuaca

SEQ ID NO: 778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccaauguguccuacatt

SEQ ID NO: 779 - RNA, 19 nt, Artificial Sequence
  source: /note="Description of Artificial Sequence: Synthetic oligonucleotide"
uguaggacacauugggcuc

SEQ ID NO: 780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaggacacauugggcuctt

SEQ ID NO: 781 - RNA, 19 nt, Artificial Sequence
  source: /note="Description of Artificial Sequence: Synthetic oligonucleotide"
uguccuacaucugcucucg

SEQ ID NO: 782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccuacaucugcucucgtt

SEQ ID NO: 783 - RNA, 19 nt, Artificial Sequence
  source: /note="Description of Artificial Sequence: Synthetic oligonucleotide"
cgagagcagauguaggaca

SEQ ID NO: 784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagagcagauguaggacatt

SEQ ID NO: 785 - RNA, 19 nt, Artificial Sequence
  source: /note="Description of Artificial Sequence: Synthetic oligonucleotide"
guccuacaucugcucucgg

SEQ ID NO: 786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuacaucugcucucggtt

SEQ ID NO: 787 - RNA, 19 nt, Artificial Sequence
  source: /note="Description of Artificial Sequence: Synthetic oligonucleotide"
ccgagagcagauguaggac

SEQ ID NO: 788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagagcagauguaggactt

SEQ ID NO: 789 - RNA, 19 nt, Artificial Sequence
  source: /note="Description of Artificial Sequence: Synthetic oligonucleotide"
uccuacaucugcucucggu

SEQ ID NO: 790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuacaucugcucucggutt

SEQ ID NO: 791 - RNA, 19 nt, Artificial Sequence
  source: /note="Description of Artificial Sequence: Synthetic oligonucleotide"
accgagagcagauguagga

SEQ ID NO: 792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgagagcagauguaggatt

SEQ ID NO: 793 - RNA, 19 nt, Artificial Sequence
  source: /note="Description of Artificial Sequence: Synthetic oligonucleotide"
ccacagauuacaccucguc

SEQ ID NO: 794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagauuacaccucguctt

SEQ ID NO: 795 - RNA, 19 nt, Artificial Sequence
  source: /note="Description of Artificial Sequence: Synthetic oligonucleotide"
gacgagguguaaucugugg

SEQ ID NO: 796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgagguguaaucuguggtt

SEQ ID NO: 797 - RNA, 19 nt, Artificial Sequence
  source: /note="Description of Artificial Sequence: Synthetic oligonucleotide"
gcuacuucucggccagccc

SEQ ID NO: 798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuacuucucggccagccctt

SEQ ID NO: 799 - RNA, 19 nt, Artificial Sequence
  source: /note="Description of Artificial Sequence: Synthetic oligonucleotide"
gggcuggccgagaaguagc

SEQ ID NO: 800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuggccgagaaguagctt

SEQ ID NO: 801 - RNA, 19 nt, Artificial Sequence
  source: /note="Description of Artificial Sequence: Synthetic oligonucleotide"
aacugcggagacucggagc

SEQ ID NO: 802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugcggagacucggagctt

SEQ ID NO: 803 - RNA, 19 nt, Artificial Sequence
  source: /note="Description of Artificial Sequence: Synthetic oligonucleotide"
gcuccgagucuccgcaguu

SEQ ID NO: 804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccgagucuccgcaguutt

SEQ ID NO: 805 - RNA, 19 nt, Artificial Sequence
  source: /note="Description of Artificial Sequence: Synthetic oligonucleotide"
uccccaacgaccgcccgcu

SEQ ID NO: 806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccaacgaccgcccgcutt

SEQ ID NO: 807 - RNA, 19 nt, Artificial Sequence
  source: /note="Description of Artificial Sequence: Synthetic oligonucleotide"
agcgggcggucguugggga

SEQ ID NO: 808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgggcggucguuggggatt

SEQ ID NO: 809 - RNA, 19 nt, Artificial Sequence
  source: /note="Description of Artificial Sequence: Synthetic oligonucleotide"
uguaaauagaaccagccca

SEQ ID NO: 810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaaauagaaccagcccatt

SEQ ID NO: 811 - RNA, 19 nt, Artificial Sequence
  source: /note="Description of Artificial Sequence: Synthetic oligonucleotide"
ugggcugguucuauuuaca

SEQ ID NO: 812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcugguucuauuuacatt

SEQ ID NO: 813 - RNA, 19 nt, Artificial Sequence
  source: /note="Description of Artificial Sequence: Synthetic oligonucleotide"
cccuggguguaaauagauu

SEQ ID NO: 814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggguguaaauagauutt

SEQ ID NO: 815 - RNA, 19 nt, Artificial Sequence
  source: /note="Description of Artificial Sequence: Synthetic oligonucleotide"
aaucuauuuacacccaggg

SEQ ID NO: 816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucuauuuacacccagggtt

SEQ ID NO: 817 - RNA, 19 nt, Artificial Sequence
  source: /note="Description of Artificial Sequence: Synthetic oligonucleotide"
cgucaauucacaccauuca

SEQ ID NO: 818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucaauucacaccauucatt

SEQ ID NO: 819 - RNA, 19 nt, Artificial Sequence
  source: /note="Description of Artificial Sequence: Synthetic oligonucleotide"
ugaauggugugaauugacg

SEQ ID NO: 820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaauggugugaauugacgtt

SEQ ID NO: 821 - RNA, 19 nt, Artificial Sequence
  source: /note="Description of Artificial Sequence: Synthetic oligonucleotide"
uguacagaccucuguucaa

SEQ ID NO: 822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacagaccucuguucaatt

SEQ ID NO: 823 - RNA, 19 nt, Artificial Sequence
  source: /note="Description of Artificial Sequence: Synthetic oligonucleotide"
uugaacagaggucuguaca

SEQ ID NO: 824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaacagaggucuguacatt

SEQ ID NO: 825 - RNA, 19 nt, Artificial Sequence
  source: /note="Description of Artificial Sequence: Synthetic oligonucleotide"
cuguucaauaaauuauugg

SEQ ID NO: 826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguucaauaaauuauuggtt

SEQ ID NO: 827 - RNA, 19 nt, Artificial Sequence
  source: /note="Description of Artificial Sequence: Synthetic oligonucleotide"
ccaauaauuuauugaacag

SEQ ID NO: 828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaauaauuuauugaacagtt

SEQ ID NO: 829 - RNA, 19 nt, Artificial Sequence
  source: /note="Description of Artificial Sequence: Synthetic oligonucleotide"
acaacgaagccgacggcag

SEQ ID NO: 830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaacgaagccgacggcagtt

SEQ ID NO: 831 - RNA, 19 nt, Artificial Sequence
  source: /note="Description of Artificial Sequence: Synthetic oligonucleotide"
cugccgucggcuucguugu

SEQ ID NO: 832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccgucggcuucguugutt

SEQ ID NO: 833 - RNA, 19 nt, Artificial Sequence
  source: /note="Description of Artificial Sequence: Synthetic oligonucleotide"
caacgaagccgacggcaga

SEQ ID NO: 834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacgaagccgacggcagatt

SEQ ID NO: 835 - RNA, 19 nt, Artificial Sequence
  source: /note="Description of Artificial Sequence: Synthetic oligonucleotide"
ucugccgucggcuucguug

SEQ ID NO: 836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugccgucggcuucguugtt

SEQ ID NO: 837 - RNA, 19 nt, Artificial Sequence
  source: /note="Description of Artificial Sequence: Synthetic oligonucleotide"
gagcccgaacggcgcggcc

SEQ ID NO: 838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccgaacggcgcggcctt

SEQ ID NO: 839 - RNA, 19 nt, Artificial Sequence
  source: /note="Description of Artificial Sequence: Synthetic oligonucleotide"
ggccgcgccguucgggcuc

SEQ ID NO: 840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgcgccguucgggcuctt

SEQ ID NO: 841 - RNA, 19 nt, Artificial Sequence
  source: /note="Description of Artificial Sequence: Synthetic oligonucleotide"
gccugcgcucggcgccaug

SEQ ID NO: 842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugcgcucggcgccaugtt

SEQ ID NO: 843 - RNA, 19 nt, Artificial Sequence
  source: /note="Description of Artificial Sequence: Synthetic oligonucleotide"
cauggcgccgagcgcaggc

SEQ ID NO: 844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauggcgccgagcgcaggctt

SEQ ID NO: 845 - RNA, 19 nt, Artificial Sequence
  source: /note="Description of Artificial Sequence: Synthetic oligonucleotide"
cgcgggcacuagcuucccg

SEQ ID NO: 846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcgggcacuagcuucccgtt

SEQ ID NO: 847 - RNA, 19 nt, Artificial Sequence
  source: /note="Description of Artificial Sequence: Synthetic oligonucleotide"
cgggaagcuagugcccgcg

SEQ ID NO: 848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggaagcuagugcccgcgtt

SEQ ID NO: 849 - RNA, 19 nt, Artificial Sequence
  source: /note="Description of Artificial Sequence: Synthetic oligonucleotide"
gccgugacagcgggaaggu

SEQ ID NO: 850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgugacagcgggaaggutt

SEQ ID NO: 851 - RNA, 19 nt, Artificial Sequence
  source: /note="Description of Artificial Sequence: Synthetic oligonucleotide"
accuucccgcugucacggc

SEQ ID NO: 852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuucccgcugucacggctt

SEQ ID NO: 853 - RNA, 19 nt, Artificial Sequence
  source: /note="Description of Artificial Sequence: Synthetic oligonucleotide"
gaaguggcuuacacugaca

SEQ ID NO: 854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaguggcuuacacugacatt

SEQ ID NO: 855 - RNA, 19 nt, Artificial Sequence
  source: /note="Description of Artificial Sequence: Synthetic oligonucleotide"
ugucaguguaagccacuuc

SEQ ID NO: 856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucaguguaagccacuuctt

SEQ ID NO: 857 - RNA, 19 nt, Artificial Sequence
  source: /note="Description of Artificial Sequence: Synthetic oligonucleotide"
guucaagaaccgagaacug

SEQ ID NO: 858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaagaaccgagaacugtt

SEQ ID NO: 859 - RNA, 19 nt, Artificial Sequence
  source: /note="Description of Artificial Sequence: Synthetic oligonucleotide"
caguucucgguucuugaac

SEQ ID NO: 860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguucucgguucuugaactt

SEQ ID NO: 861 - RNA, 19 nt, Artificial Sequence
  source: /note="Description of Artificial Sequence: Synthetic oligonucleotide"
uucaagaaccgagaacugc

SEQ ID NO: 862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaagaaccgagaacugctt

SEQ ID NO: 863 - RNA, 19 nt, Artificial Sequence
  source: /note="Description of Artificial Sequence: Synthetic oligonucleotide"
gcaguucucgguucuugaa

SEQ ID NO: 864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaguucucgguucuugaatt

SEQ ID NO: 865 - RNA, 19 nt, Artificial Sequence
  source: /note="Description of Artificial Sequence: Synthetic oligonucleotide"
ugcccgagacgguguaccg

SEQ ID NO: 866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccgagacgguguaccgtt

SEQ ID NO: 867 - RNA, 19 nt, Artificial Sequence
  source: /note="Description of Artificial Sequence: Synthetic oligonucleotide"
cgguacaccgucucgggca

SEQ ID NO: 868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguacaccgucucgggcatt

SEQ ID NO: 869 - RNA, 19 nt, Artificial Sequence
  source: /note="Description of Artificial Sequence: Synthetic oligonucleotide"
gaugaacugcggagacucg

SEQ ID NO: 870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaacugcggagacucgtt

SEQ ID NO: 871 - RNA, 19 nt, Artificial Sequence
  source: /note="Description of Artificial Sequence: Synthetic oligonucleotide"
cgagucuccgcaguucauc

SEQ ID NO: 872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagucuccgcaguucauctt

SEQ ID NO: 873 - RNA, 19 nt, Artificial Sequence
  source: /note="Description of Artificial Sequence: Synthetic oligonucleotide"
augaacugcggagacucgg

SEQ ID NO: 874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaacugcggagacucggtt

SEQ ID NO: 875 - RNA, 19 nt, Artificial Sequence
  source: /note="Description of Artificial Sequence: Synthetic oligonucleotide"
ccgagucuccgcaguucau

SEQ ID NO: 876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagucuccgcaguucautt

SEQ ID NO: 877 - RNA, 19 nt, Artificial Sequence
  source: /note="Description of Artificial Sequence: Synthetic oligonucleotide"
cccgcuucccccccuguuc

SEQ ID NO: 878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgcuucccccccuguuctt

SEQ ID NO: 879 - RNA, 19 nt, Artificial Sequence
  source: /note="Description of Artificial Sequence: Synthetic oligonucleotide"
gaacagggggggaagcggg

SEQ ID NO: 880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacagggggggaagcgggtt

SEQ ID NO: 881 - RNA, 19 nt, Artificial Sequence
  source: /note="Description of Artificial Sequence: Synthetic oligonucleotide"
ccgcuucccccccuguuca

SEQ ID NO: 882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcuucccccccuguucatt

SEQ ID NO: 883 - RNA, 19 nt, Artificial Sequence
  source: /note="Description of Artificial Sequence: Synthetic oligonucleotide"
ugaacagggggggaagcgg

SEQ ID NO: 884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacagggggggaagcggtt

SEQ ID NO: 885 - RNA, 19 nt, Artificial Sequence
  source: /note="Description of Artificial Sequence: Synthetic oligonucleotide"
aguccuggugaacugucca

SEQ ID NO: 886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguccuggugaacuguccatt

SEQ ID NO: 887 - RNA, 19 nt, Artificial Sequence
  source: /note="Description of Artificial Sequence: Synthetic oligonucleotide"
uggacaguucaccaggacu

SEQ ID NO: 888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacaguucaccaggacutt

SEQ ID NO: 889 - RNA, 19 nt, Artificial Sequence
  source: /note="Description of Artificial Sequence: Synthetic oligonucleotide"
gggggugugaggaccuucu

SEQ ID NO: 890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggugugaggaccuucutt

SEQ ID NO: 891 - RNA, 19 nt, Artificial Sequence
  source: /note="Description of Artificial Sequence: Synthetic oligonucleotide"
agaagguccucacaccccc

SEQ ID NO: 892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagguccucacaccccctt

SEQ ID NO: 893 - RNA, 19 nt, Artificial Sequence
  source: /note="Description of Artificial Sequence: Synthetic oligonucleotide"
cccccaggcuaccacuccu

SEQ ID NO: 894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccaggcuaccacuccutt

SEQ ID NO: 895 - RNA, 19 nt, Artificial Sequence
  source: /note="Description of Artificial Sequence: Synthetic oligonucleotide"
aggagugguagccuggggg

SEQ ID NO: 896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggagugguagccugggggtt

SEQ ID NO: 897 - RNA, 19 nt, Artificial Sequence
  source: /note="Description of Artificial Sequence: Synthetic oligonucleotide"
uuguaaauagaaccagccc

SEQ ID NO: 898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguaaauagaaccagccctt

SEQ ID NO: 899 - RNA, 19 nt, Artificial Sequence
  source: /note="Description of Artificial Sequence: Synthetic oligonucleotide"
gggcugguucuauuuacaa

SEQ ID NO: 900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcugguucuauuuacaatt

SEQ ID NO: 901 - RNA, 19 nt, Artificial Sequence
  source: /note="Description of Artificial Sequence: Synthetic oligonucleotide"
aaauagaaccagcccagcc

SEQ ID NO: 902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauagaaccagcccagcctt

SEQ ID NO: 903 - RNA, 19 nt, Artificial Sequence
  source: /note="Description of Artificial Sequence: Synthetic oligonucleotide"
ggcugggcugguucuauuu

SEQ ID NO: 904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugggcugguucuauuutt

SEQ ID NO: 905 - RNA, 19 nt, Artificial Sequence
  source: /note="Description of Artificial Sequence: Synthetic oligonucleotide"
ucuuaaagaaaacgucaau

SEQ ID NO: 906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuaaagaaaacgucaautt

SEQ ID NO: 907 - RNA, 19 nt, Artificial Sequence
  source: /note="Description of Artificial Sequence: Synthetic oligonucleotide"
auugacguuuucuuuaaga

SEQ ID NO: 908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugacguuuucuuuaagatt

SEQ ID NO: 909 - RNA, 19 nt, Artificial Sequence
  source: /note="Description of Artificial Sequence: Synthetic oligonucleotide"
aaagaaaacgucaauucac

SEQ ID NO: 910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagaaaacgucaauucactt

SEQ ID NO: 911 - RNA, 19 nt, Artificial Sequence
  source: /note="Description of Artificial Sequence: Synthetic oligonucleotide"
gugaauugacguuuucuuu

SEQ ID NO: 912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaauugacguuuucuuutt

SEQ ID NO: 913 - RNA, 19 nt, Artificial Sequence
  source: /note="Description of Artificial Sequence: Synthetic oligonucleotide"
guggugacaacgaagccga

SEQ ID NO: 914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggugacaacgaagccgatt

SEQ ID NO: 915 - RNA, 19 nt, Artificial Sequence
  source: /note="Description of Artificial Sequence: Synthetic oligonucleotide"
ucggcuucguugucaccac

SEQ ID NO: 916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggcuucguugucaccactt

SEQ ID NO: 917 - RNA, 19 nt, Artificial Sequence
  source: /note="Description of Artificial Sequence: Synthetic oligonucleotide"
cgaagccgacggcagaggg

SEQ ID NO: 918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaagccgacggcagagggtt

SEQ ID NO: 919 - RNA, 19 nt, Artificial Sequence
  source: /note="Description of Artificial Sequence: Synthetic oligonucleotide"
cccucugccgucggcuucg

SEQ ID NO: 920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucugccgucggcuucgtt

SEQ ID NO: 921 - RNA, 19 nt, Artificial Sequence
  source: /note="Description of Artificial Sequence: Synthetic oligonucleotide"
gagccggagcccgaacggc

SEQ ID NO: 922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccggagcccgaacggctt

SEQ ID NO: 923 - RNA, 19 nt, Artificial Sequence
  source: /note="Description of Artificial Sequence: Synthetic oligonucleotide"
gccguucgggcuccggcuc

SEQ ID NO: 924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccguucgggcuccggcuctt

SEQ ID NO: 925 - RNA, 19 nt, Artificial Sequence
  source: /note="Description of Artificial Sequence: Synthetic oligonucleotide"
ccggagcccgaacggcgcg

SEQ ID NO: 926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagcccgaacggcgcgtt

SEQ ID NO: 927 - RNA, 19 nt, Artificial Sequence
  source: /note="Description of Artificial Sequence: Synthetic oligonucleotide"
cgcgccguucgggcuccgg

SEQ ID NO: 928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcgccguucgggcuccggtt

SEQ ID NO: 929 - RNA, 19 nt, Artificial Sequence
  source: /note="Description of Artificial Sequence: Synthetic oligonucleotide"
caggcagcccgagccccgc

SEQ ID NO: 930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcagcccgagccccgctt

SEQ ID NO: 931 - RNA, 19 nt, Artificial Sequence
  source: /note="Description of Artificial Sequence: Synthetic oligonucleotide"
gcggggcucgggcugccug

SEQ ID NO: 932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggggcucgggcugccugtt

SEQ ID NO: 933 - RNA, 19 nt, Artificial Sequence
  source: /note="Description of Artificial Sequence: Synthetic oligonucleotide"
cugcgcucggcgccaugag

SEQ ID NO: 934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcgcucggcgccaugagtt

SEQ ID NO: 935 - RNA, 19 nt, Artificial Sequence
  source: /note="Description of Artificial Sequence: Synthetic oligonucleotide"
cucauggcgccgagcgcag

SEQ ID NO: 936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucauggcgccgagcgcagtt

SEQ ID NO: 937 - RNA, 19 nt, Artificial Sequence
  source: /note="Description of Artificial Sequence: Synthetic oligonucleotide"
gcgcucggcgccaugagcg

SEQ ID NO: 938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcucggcgccaugagcgtt

SEQ ID NO: 939 - RNA, 19 nt, Artificial Sequence
  source: /note="Description of Artificial Sequence: Synthetic oligonucleotide"
cgcucauggcgccgagcgc

SEQ ID NO: 940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcucauggcgccgagcgctt

SEQ ID NO: 941 - RNA, 19 nt, Artificial Sequence
  source: /note="Description of Artificial Sequence: Synthetic oligonucleotide"
gcggcggcgggccuucggg

SEQ ID NO: 942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcggcgggccuucgggtt

SEQ ID NO: 943 - RNA, 19 nt, Artificial Sequence
  source: /note="Description of Artificial Sequence: Synthetic oligonucleotide"
cccgaaggcccgccgccgc

SEQ ID NO: 944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgaaggcccgccgccgctt

SEQ ID NO: 945 - RNA, 19 nt, Artificial Sequence
  source: /note="Description of Artificial Sequence: Synthetic oligonucleotide"
gcgggccuucgggaggcgg

SEQ ID NO: 946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggccuucgggaggcggtt

SEQ ID NO: 947 - RNA, 19 nt, Artificial Sequence
  source: /note="Description of Artificial Sequence: Synthetic oligonucleotide"
ccgccucccgaaggcccgc

SEQ ID NO: 948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccucccgaaggcccgctt

SEQ ID NO: 949 - RNA, 19 nt, Artificial Sequence
  source: /note="Description of Artificial Sequence: Synthetic oligonucleotide"
cugggggcucgggccgggc

SEQ ID NO: 950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggggcucgggccgggctt

SEQ ID NO: 951 - RNA, 19 nt, Artificial Sequence
  source: /note="Description of Artificial Sequence: Synthetic oligonucleotide"
gcccggcccgagcccccag

SEQ ID NO: 952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccggcccgagcccccagtt

SEQ ID NO: 953 - RNA, 19 nt, Artificial Sequence
  source: /note="Description of Artificial Sequence: Synthetic oligonucleotide"
gggcgcggaccagcucguu

SEQ ID NO: 954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcgcggaccagcucguutt

SEQ ID NO: 955 - RNA, 19 nt, Artificial Sequence
  source: /note="Description of Artificial Sequence: Synthetic oligonucleotide"
aacgagcugguccgcgccc

SEQ ID NO: 956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgagcugguccgcgccctt

SEQ ID NO: 957 - RNA, 19 nt, Artificial Sequence
  source: /note="Description of Artificial Sequence: Synthetic oligonucleotide"
cccaggaggcacuggcggc

SEQ ID NO: 958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggaggcacuggcggctt

SEQ ID NO: 959 - RNA, 19 nt, Artificial Sequence
  source: /note="Description of Artificial Sequence: Synthetic oligonucleotide"
gccgccagugccuccuggg

SEQ ID NO: 960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccagugccuccugggtt

SEQ ID NO: 961 - RNA, 19 nt, Artificial Sequence
  source: /note="Description of Artificial Sequence: Synthetic oligonucleotide"
ggaaagcgucagucggggc

SEQ ID NO: 962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaagcgucagucggggctt

SEQ ID NO: 963 - RNA, 19 nt, Artificial Sequence
  source: /note="Description of Artificial Sequence: Synthetic oligonucleotide"
gccccgacugacgcuuucc

SEQ ID NO: 964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccgacugacgcuuucctt

SEQ ID NO: 965 - RNA, 19 nt, Artificial Sequence
  source: /note="Description of Artificial Sequence: Synthetic oligonucleotide"
cgggcacuagcuucccgcc

SEQ ID NO: 966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcacuagcuucccgcctt

SEQ ID NO: 967 - RNA, 19 nt, Artificial Sequence
  source: /note="Description of Artificial Sequence: Synthetic oligonucleotide"
ggcgggaagcuagugcccg

SEQ ID NO: 968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggaagcuagugcccgtt

SEQ ID NO: 969 - RNA, 19 nt, Artificial Sequence
  source: /note="Description of Artificial Sequence: Synthetic oligonucleotide"
cccgccgccgggagugaag

SEQ ID NO: 970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccgccgggagugaagtt

SEQ ID NO: 971 - RNA, 19 nt, Artificial Sequence
  source: /note="Description of Artificial Sequence: Synthetic oligonucleotide"
cuucacucccggcggcggg

SEQ ID NO: 972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucacucccggcggcgggtt

SEQ ID NO: 973 - RNA, 19 nt, Artificial Sequence
  source: /note="Description of Artificial Sequence: Synthetic oligonucleotide"
gaagcugggccgugacagc

SEQ ID NO: 974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcugggccgugacagctt

SEQ ID NO: 975 - RNA, 19 nt, Artificial Sequence
  source: /note="Description of Artificial Sequence: Synthetic oligonucleotide"
gcugucacggcccagcuuc

SEQ ID NO: 976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugucacggcccagcuuctt

SEQ ID NO: 977 - RNA, 19 nt, Artificial Sequence
  source: /note="Description of Artificial Sequence: Synthetic oligonucleotide"
caagaaguggcuuacacug

SEQ ID NO: 978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagaaguggcuuacacugtt

SEQ ID NO: 979 - RNA, 19 nt, Artificial Sequence
  source: /note="Description of Artificial Sequence: Synthetic oligonucleotide"
caguguaagccacuucuug

SEQ ID NO: 980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguguaagccacuucuugtt

SEQ ID NO: 981 - RNA, 19 nt, Artificial Sequence
  source: /note="Description of Artificial Sequence: Synthetic oligonucleotide"
aagaaguggcuuacacuga

SEQ ID NO: 982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaguggcuuacacugatt

SEQ ID NO: 983 - RNA, 19 nt, Artificial Sequence
  source: /note="Description of Artificial Sequence: Synthetic oligonucleotide"
ucaguguaagccacuucuu

SEQ ID NO: 984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguguaagccacuucuutt

SEQ ID NO: 985 - RNA, 19 nt, Artificial Sequence
  source: /note="Description of Artificial Sequence: Synthetic oligonucleotide"
agaaguggcuuacacugac

SEQ ID NO: 986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaguggcuuacacugactt

SEQ ID NO: 987 - RNA, 19 nt, Artificial Sequence
  source: /note="Description of Artificial Sequence: Synthetic oligonucleotide"
gucaguguaagccacuucu

SEQ ID NO: 988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaguguaagccacuucutt

SEQ ID NO: 989 - RNA, 19 nt, Artificial Sequence
  source: /note="Description of Artificial Sequence: Synthetic oligonucleotide"
caaggccaagcugaucacc

SEQ ID NO: 990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggccaagcugaucacctt

SEQ ID NO: 991 - RNA, 19 nt, Artificial Sequence
  source: /note="Description of Artificial Sequence: Synthetic oligonucleotide"
ggugaucagcuuggccuug

SEQ ID NO: 992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugaucagcuuggccuugtt

SEQ ID NO: 993 - RNA, 19 nt, Artificial Sequence
  source: /note="Description of Artificial Sequence: Synthetic oligonucleotide"
ccaagcugaucaccccuau

SEQ ID NO: 994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagcugaucaccccuautt

SEQ ID NO: 995 - RNA, 19 nt, Artificial Sequence
  source: /note="Description of Artificial Sequence: Synthetic oligonucleotide"
auaggggugaucagcuugg

SEQ ID NO: 996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaggggugaucagcuuggtt

SEQ ID NO: 997 - RNA, 19 nt, Artificial Sequence
  source: /note="Description of Artificial Sequence: Synthetic oligonucleotide"
cacucccaagguguguguc

SEQ ID NO: 998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucccaagguguguguctt

SEQ ID NO: 999 - RNA, 19 nt, Artificial Sequence
  source: /note="Description of Artificial Sequence: Synthetic oligonucleotide"
gacacacaccuugggagug

SEQ ID NO: 1000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacacaccuugggagugtt

SEQ ID NO: 1001 - RNA, 19 nt, Artificial Sequence
  source: /note="Description of Artificial Sequence: Synthetic oligonucleotide"
acucccaagguguguguca

SEQ ID NO: 1002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucccaaggugugugucatt

SEQ ID NO: 1003 - RNA, 19 nt, Artificial Sequence
  source: /note="Description of Artificial Sequence: Synthetic oligonucleotide"
ugacacacaccuugggagu

SEQ ID NO: 1004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacacacaccuugggagutt

SEQ ID NO: 1005 - RNA, 19 nt, Artificial Sequence
  source: /note="Description of Artificial Sequence: Synthetic oligonucleotide"
gcaaagcagcugguucggg

SEQ ID NO: 1006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaagcagcugguucgggtt

SEQ ID NO: 1007 - RNA, 19 nt, Artificial Sequence
  source: /note="Description of Artificial Sequence: Synthetic oligonucleotide"
cccgaaccagcugcuuugc

SEQ ID NO: 1008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgaaccagcugcuuugctt

SEQ ID NO: 1009 - RNA, 19 nt, Artificial Sequence
  source: /note="Description of Artificial Sequence: Synthetic oligonucleotide"
aaagcagcugguucggggg

SEQ ID NO: 1010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcagcugguucgggggtt

SEQ ID NO: 1011 - RNA, 19 nt, Artificial Sequence
  source: /note="Description of Artificial Sequence: Synthetic oligonucleotide"
cccccgaaccagcugcuuu

SEQ ID NO: 1012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccgaaccagcugcuuutt

SEQ ID NO: 1013 - RNA, 19 nt, Artificial Sequence
  source: /note="Description of Artificial Sequence: Synthetic oligonucleotide"
cagcugguucggggggagc

SEQ ID NO: 1014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcugguucggggggagctt

SEQ ID NO: 1015 - RNA, 19 nt, Artificial Sequence
  source: /note="Description of Artificial Sequence: Synthetic oligonucleotide"
gcuccccccgaaccagcug

SEQ ID NO: 1016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccccccgaaccagcugtt

SEQ ID NO: 1017 - RNA, 19 nt, Artificial Sequence
  source: /note="Description of Artificial Sequence: Synthetic oligonucleotide"
gggggagcccaaugugucc

SEQ ID NO: 1018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggagcccaaugugucctt

SEQ ID NO: 1019 - RNA, 19 nt, Artificial Sequence
  source: /note="Description of Artificial Sequence: Synthetic oligonucleotide"
ggacacauugggcuccccc

SEQ ID NO: 1020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacacauugggcuccccctt

SEQ ID NO: 1021 - RNA, 19 nt, Artificial Sequence
  source: /note="Description of Artificial Sequence: Synthetic oligonucleotide"
gcccaauguguccuacauc

SEQ ID NO: 1022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaauguguccuacauctt

SEQ ID NO: 1023 - RNA, 19 nt, Artificial Sequence
  source: /note="Description of Artificial Sequence: Synthetic oligonucleotide"
gauguaggacacauugggc

SEQ ID NO: 1024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauguaggacacauugggctt

SEQ ID NO: 1025 - RNA, 19 nt, Artificial Sequence
  source: /note="Description of Artificial Sequence: Synthetic oligonucleotide"
ucugcucucgguacuaccg

SEQ ID NO: 1026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcucucgguacuaccgtt

SEQ ID NO: 1027 - RNA, 19 nt, Artificial Sequence
  source: /note="Description of Artificial Sequence: Synthetic oligonucleotide"
cgguaguaccgagagcaga

SEQ ID NO: 1028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguaguaccgagagcagatt

SEQ ID NO: 1029 - RNA, 19 nt, Artificial Sequence
  source: /note="Description of Artificial Sequence: Synthetic oligonucleotide"
ucggcuggcuguguacuug

SEQ ID NO: 1030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggcuggcuguguacuugtt

SEQ ID NO: 1031 - RNA, 19 nt, Artificial Sequence
  source: /note="Description of Artificial Sequence: Synthetic oligonucleotide"
caaguacacagccagccga

SEQ ID NO: 1032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaguacacagccagccgatt

SEQ ID NO: 1033 - RNA, 19 nt, Artificial Sequence
  source: /note="Description of Artificial Sequence: Synthetic oligonucleotide"
uggcuguguacuugcugag

SEQ ID NO: 1034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuguguacuugcugagtt

SEQ ID NO: 1035 - RNA, 19 nt, Artificial Sequence
  source: /note="Description of Artificial Sequence: Synthetic oligonucleotide"
cucagcaaguacacagcca

SEQ ID NO: 1036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucagcaaguacacagccatt

SEQ ID NO: 1037 - RNA, 19 nt, Artificial Sequence
  source: /note="Description of Artificial Sequence: Synthetic oligonucleotide"
uugcugagcuacuucucgg

SEQ ID NO: 1038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcugagcuacuucucggtt

SEQ ID NO: 1039 - RNA, 19 nt, Artificial Sequence
  source: /note="Description of Artificial Sequence: Synthetic oligonucleotide"
ccgagaaguagcucagcaa

SEQ ID NO: 1040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagaaguagcucagcaatt

SEQ ID NO: 1041 - RNA, 19 nt, Artificial Sequence
  source: /note="Description of Artificial Sequence: Synthetic oligonucleotide"
gcugagcuacuucucggcc

SEQ ID NO: 1042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugagcuacuucucggcctt

SEQ ID NO: 1043 - RNA, 19 nt, Artificial Sequence
  source: /note="Description of Artificial Sequence: Synthetic oligonucleotide"
ggccgagaaguagcucagc

SEQ ID NO: 1044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgagaaguagcucagctt

SEQ ID NO: 1045 - RNA, 19 nt, Artificial Sequence
  source: /note="Description of Artificial Sequence: Synthetic oligonucleotide"
aucaaagcucacccuugga

SEQ ID NO: 1046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaaagcucacccuuggatt

SEQ ID NO: 1047 - RNA, 19 nt, Artificial Sequence
  source: /note="Description of Artificial Sequence: Synthetic oligonucleotide"
uccaagggugagcuuugau

SEQ ID NO: 1048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaagggugagcuuugautt

SEQ ID NO: 1049 - RNA, 19 nt, Artificial Sequence
  source: /note="Description of Artificial Sequence: Synthetic oligonucleotide"
cucugcucuagccuacugg

SEQ ID NO: 1050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugcucuagccuacuggtt

SEQ ID NO: 1051 - RNA, 19 nt, Artificial Sequence
  source: /note="Description of Artificial Sequence: Synthetic oligonucleotide"
ccaguaggcuagagcagag

SEQ ID NO: 1052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaguaggcuagagcagagtt

SEQ ID NO: 1053 - RNA, 19 nt, Artificial Sequence
  source: /note="Description of Artificial Sequence: Synthetic oligonucleotide"
acuggaguacacgccaucc

SEQ ID NO: 1054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggaguacacgccaucctt

SEQ ID NO: 1055 - RNA, 19 nt, Artificial Sequence
  source: /note="Description of Artificial Sequence: Synthetic oligonucleotide"
ggauggcguguacuccagu

SEQ ID NO: 1056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauggcguguacuccagutt

SEQ ID NO: 1057 - RNA, 19 nt, Artificial Sequence
  source: /note="Description of Artificial Sequence: Synthetic oligonucleotide"
aaggcucuccccacucgag

SEQ ID NO: 1058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcucuccccacucgagtt

SEQ ID NO: 1059 - RNA, 19 nt, Artificial Sequence
  source: /note="Description of Artificial Sequence: Synthetic oligonucleotide"
cucgaguggggagagccuu

SEQ ID NO: 1060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgaguggggagagccuutt

SEQ ID NO: 1061 - RNA, 19 nt, Artificial Sequence
  source: /note="Description of Artificial Sequence: Synthetic oligonucleotide"
ugcggagacucggagccca

SEQ ID NO: 1062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcggagacucggagcccatt

SEQ ID NO: 1063 - RNA, 19 nt, Artificial Sequence
  source: /note="Description of Artificial Sequence: Synthetic oligonucleotide"
ugggcuccgagucuccgca

SEQ ID NO: 1064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuccgagucuccgcatt

SEQ ID NO: 1065 - RNA, 19 nt, Artificial Sequence
  source: /note="Description of Artificial Sequence: Synthetic oligonucleotide"
acaacccauccucacaagc

SEQ ID NO: 1066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaacccauccucacaagctt

SEQ ID NO: 1067 - RNA, 19 nt, Artificial Sequence
  source: /note="Description of Artificial Sequence: Synthetic oligonucleotide"
gcuugugaggauggguugu

SEQ ID NO: 1068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugugaggauggguugutt

SEQ ID NO: 1069 - RNA, 19 nt, Artificial Sequence
  source: /note="Description of Artificial Sequence: Synthetic oligonucleotide"
uuuaacugaagcucagacu

SEQ ID NO: 1070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaacugaagcucagacutt

SEQ ID NO: 1071 - RNA, 19 nt, Artificial Sequence
  source: /note="Description of Artificial Sequence: Synthetic oligonucleotide"
agucugagcuucaguuaaa

SEQ ID NO: 1072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucugagcuucaguuaaatt

SEQ ID NO: 1073 - RNA, 19 nt, Artificial Sequence
  source: /note="Description of Artificial Sequence: Synthetic oligonucleotide"
gccaagauuggcagccauc

SEQ ID NO: 1074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaagauuggcagccauctt

SEQ ID NO: 1075 - RNA, 19 nt, Artificial Sequence
  source: /note="Description of Artificial Sequence: Synthetic oligonucleotide"
gauggcugccaaucuuggc

SEQ ID NO: 1076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcugccaaucuuggctt

SEQ ID NO: 1077 - RNA, 19 nt, Artificial Sequence
  source: /note="Description of Artificial Sequence: Synthetic oligonucleotide"
agauuggcagccaucugau

SEQ ID NO: 1078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuggcagccaucugautt

SEQ ID NO: 1079 - RNA, 19 nt, Artificial Sequence
  source: /note="Description of Artificial Sequence: Synthetic oligonucleotide"
aucagauggcugccaaucu

SEQ ID NO: 1080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucagauggcugccaaucutt

SEQ ID NO: 1081 - RNA, 19 nt, Artificial Sequence
  source: /note="Description of Artificial Sequence: Synthetic oligonucleotide"
auuggcagccaucugaugc

SEQ ID NO: 1082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuggcagccaucugaugctt

SEQ ID NO: 1083 - RNA, 19 nt, Artificial Sequence
  source: /note="Description of Artificial Sequence: Synthetic oligonucleotide"
gcaucagauggcugccaau

SEQ ID NO: 1084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaucagauggcugccaautt

SEQ ID NO: 1085 - RNA, 19 nt, Artificial Sequence
  source: /note="Description of Artificial Sequence: Synthetic oligonucleotide"
ucccucagcagccuaaccu

SEQ ID NO: 1086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucagcagccuaaccutt

SEQ ID NO: 1087 - RNA, 19 nt, Artificial Sequence
  source: /note="Description of Artificial Sequence: Synthetic oligonucleotide"
agguuaggcugcugaggga

SEQ ID NO: 1088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguuaggcugcugagggatt

SEQ ID NO: 1089 - RNA, 19 nt, Artificial Sequence
  source: /note="Description of Artificial Sequence: Synthetic oligonucleotide"
aaagaggauuuuaacuguu

SEQ ID NO: 1090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagaggauuuuaacuguutt

SEQ ID NO: 1091 - RNA, 19 nt, Artificial Sequence
  source: /note="Description of Artificial Sequence: Synthetic oligonucleotide"
aacaguuaaaauccucuuu

SEQ ID NO: 1092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaguuaaaauccucuuutt

SEQ ID NO: 1093 - RNA, 19 nt, Artificial Sequence
  source: /note="Description of Artificial Sequence: Synthetic oligonucleotide"
gaggauuuuaacuguuugu

SEQ ID NO: 1094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggauuuuaacuguuugutt

SEQ ID NO: 1095 - RNA, 19 nt, Artificial Sequence
  source: /note="Description of Artificial Sequence: Synthetic oligonucleotide"
acaaacaguuaaaauccuc

SEQ ID NO: 1096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaacaguuaaaauccuctt

SEQ ID NO: 1097 - RNA, 19 nt, Artificial Sequence
  source: /note="Description of Artificial Sequence: Synthetic oligonucleotide"
uuuaacuguuuguagggga

SEQ ID NO: 1098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaacuguuuguaggggatt

SEQ ID NO: 1099 - RNA, 19 nt, Artificial Sequence
  source: /note="Description of Artificial Sequence: Synthetic oligonucleotide"
uccccuacaaacaguuaaa

SEQ ID NO: 1100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccuacaaacaguuaaatt

SEQ ID NO: 1101 - RNA, 19 nt, Artificial Sequence
  source: /note="Description of Artificial Sequence: Synthetic oligonucleotide"
acuguuuguaggggagggg

SEQ ID NO: 1102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguuuguaggggaggggtt

SEQ ID NO: 1103 - RNA, 19 nt, Artificial Sequence
  source: /note="Description of Artificial Sequence: Synthetic oligonucleotide"
ccccuccccuacaaacagu

SEQ ID NO: 1104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuccccuacaaacagutt

SEQ ID NO: 1105 - RNA, 19 nt, Artificial Sequence
  source: /note="Description of Artificial Sequence: Synthetic oligonucleotide"
ugggggugugaggaccuuc

SEQ ID NO: 1106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggggugugaggaccuuctt

SEQ ID NO: 1107 - RNA, 19 nt, Artificial Sequence
  source: /note="Description of Artificial Sequence: Synthetic oligonucleotide"
gaagguccucacaccccca

SEQ ID NO: 1108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagguccucacacccccatt

SEQ ID NO: 1109 - RNA, 19 nt, Artificial Sequence
  source: /note="Description of Artificial Sequence: Synthetic oligonucleotide"
ucccccaggcuaccacucc

SEQ ID NO: 1110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccccaggcuaccacucctt

SEQ ID NO: 1111 - RNA, 19 nt, Artificial Sequence
  source: /note="Description of Artificial Sequence: Synthetic oligonucleotide"
ggagugguagccuggggga

SEQ ID NO: 1112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagugguagccugggggatt

SEQ ID NO: 1113 - RNA, 19 nt, Artificial Sequence
  source: /note="Description of Artificial Sequence: Synthetic oligonucleotide"
cucucccaggucccuugua

SEQ ID NO: 1114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucccaggucccuuguatt

SEQ ID NO: 1115 - RNA, 19 nt, Artificial Sequence
  source: /note="Description of Artificial Sequence: Synthetic oligonucleotide"
uacaagggaccugggagag

SEQ ID NO: 1116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaagggaccugggagagtt

SEQ ID NO: 1117 - RNA, 19 nt, Artificial Sequence
  source: /note="Description of Artificial Sequence: Synthetic oligonucleotide"
cccagcccaucucucgucu

SEQ ID NO: 1118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcccaucucucgucutt

SEQ ID NO: 1119 - RNA, 19 nt, Artificial Sequence
  source: /note="Description of Artificial Sequence: Synthetic oligonucleotide"
agacgagagaugggcuggg

SEQ ID NO: 1120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacgagagaugggcugggtt

SEQ ID NO: 1121 - RNA, 19 nt, Artificial Sequence
  source: /note="Description of Artificial Sequence: Synthetic oligonucleotide"
gcccaucucucgucuuccc

SEQ ID NO: 1122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaucucucgucuuccctt

SEQ ID NO: 1123 - RNA, 19 nt, Artificial Sequence
  source: /note="Description of Artificial Sequence: Synthetic oligonucleotide"
gggaagacgagagaugggc

SEQ ID NO: 1124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagacgagagaugggctt

SEQ ID NO: 1125 - RNA, 19 nt, Artificial Sequence
  source: /note="Description of Artificial Sequence: Synthetic oligonucleotide"
gucaauucacaccauucaa

SEQ ID NO: 1126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaauucacaccauucaatt

SEQ ID NO: 1127 - RNA, 19 nt, Artificial Sequence
  source: /note="Description of Artificial Sequence: Synthetic oligonucleotide"
uugaauggugugaauugac

SEQ ID NO: 1128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaauggugugaauugactt

SEQ ID NO: 1129 - RNA, 19 nt, Artificial Sequence
  source: /note="Description of Artificial Sequence: Synthetic oligonucleotide"
cuugccccccccagcugua

SEQ ID NO: 1130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugccccccccagcuguatt

SEQ ID NO: 1131 - RNA, 19 nt, Artificial Sequence
  source: /note="Description of Artificial Sequence: Synthetic oligonucleotide"
uacagcuggggggggcaag

SEQ ID NO: 1132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagcuggggggggcaagtt

SEQ ID NO: 1133 - RNA, 19 nt, Artificial Sequence
  source: /note="Description of Artificial Sequence: Synthetic oligonucleotide"
gaggggaguagagagaguc

SEQ ID NO: 1134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggggaguagagagaguctt

SEQ ID NO: 1135 - RNA, 19 nt, Artificial Sequence
  source: /note="Description of Artificial Sequence: Synthetic oligonucleotide"
gacucucucuacuccccuc

SEQ ID NO: 1136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacucucucuacuccccuctt

SEQ ID NO: 1137 - RNA, 19 nt, Artificial Sequence
  source: /note="Description of Artificial Sequence: Synthetic oligonucleotide"
ggaguagagagagucccug

SEQ ID NO: 1138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguagagagagucccugtt

SEQ ID NO: 1139 - RNA, 19 nt, Artificial Sequence
  source: /note="Description of Artificial Sequence: Synthetic oligonucleotide"
cagggacucucucuacucc

SEQ ID NO: 1140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggacucucucuacucctt

SEQ ID NO: 1141 - RNA, 19 nt, Artificial Sequence
  source: /note="Description of Artificial Sequence: Synthetic oligonucleotide"
uggugucuuaguuuccaca

SEQ ID NO: 1142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugucuuaguuuccacatt

SEQ ID NO: 1143 - RNA, 19 nt, Artificial Sequence
  source: /note="Description of Artificial Sequence: Synthetic oligonucleotide"
uguggaaacuaagacacca

SEQ ID NO: 1144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggaaacuaagacaccatt

SEQ ID NO: 1145 - RNA, 19 nt, Artificial Sequence
  source: /note="Description of Artificial Sequence: Synthetic oligonucleotide"
cuuaguuuccacaguaagg

SEQ ID NO: 1146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuaguuuccacaguaaggtt

SEQ ID NO: 1147 - RNA, 19 nt, Artificial Sequence
  source: /note="Description of Artificial Sequence: Synthetic oligonucleotide"
ccuuacuguggaaacuaag

SEQ ID NO: 1148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuacuguggaaacuaagtt

SEQ ID NO: 1149 - RNA, 19 nt, Artificial Sequence
  source: /note="Description of Artificial Sequence: Synthetic oligonucleotide"
caguaagguuugccugugu

SEQ ID NO: 1150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguaagguuugccugugutt

SEQ ID NO: 1151 - RNA, 19 nt, Artificial Sequence
  source: /note="Description of Artificial Sequence: Synthetic oligonucleotide"
acacaggcaaaccuuacug

SEQ ID NO: 1152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacaggcaaaccuuacugtt

SEQ ID NO: 1153 - RNA, 19 nt, Artificial Sequence
  source: /note="Description of Artificial Sequence: Synthetic oligonucleotide"
uauuggcaugaaacccuua

SEQ ID NO: 1154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuggcaugaaacccuuatt

SEQ ID NO: 1155 - RNA, 19 nt, Artificial Sequence
  source: /note="Description of Artificial Sequence: Synthetic oligonucleotide"
uaaggguuucaugccaaua

SEQ ID NO: 1156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaggguuucaugccaauatt

SEQ ID NO: 1157 - RNA, 19 nt, Artificial Sequence
  source: /note="Description of Artificial Sequence: Synthetic oligonucleotide"
gggguggccccagcggcag

SEQ ID NO: 1158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguggccccagcggcagtt

SEQ ID NO: 1159 - RNA, 19 nt, Artificial Sequence
  source: /note="Description of Artificial Sequence: Synthetic oligonucleotide"
cugccgcuggggccacccc

SEQ ID NO: 1160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccgcuggggccacccctt

SEQ ID NO: 1161 - RNA, 19 nt, Artificial Sequence
  source: /note="Description of Artificial Sequence: Synthetic oligonucleotide"
uggccccggcgcgggcacu

SEQ ID NO: 1162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccccggcgcgggcacutt

SEQ ID NO: 1163 - RNA, 19 nt, Artificial Sequence
  source: /note="Description of Artificial Sequence: Synthetic oligonucleotide"
agugcccgcgccggggcca

SEQ ID NO: 1164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcccgcgccggggccatt

SEQ ID NO: 1165 - RNA, 19 nt, Artificial Sequence
  source: /note="Description of Artificial Sequence: Synthetic oligonucleotide"
ggaggggaguagagagagu

SEQ ID NO: 1166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggggaguagagagagutt

SEQ ID NO: 1167 - RNA, 19 nt, Artificial Sequence
  source: /note="Description of Artificial Sequence: Synthetic oligonucleotide"
acucucucuacuccccucc

SEQ ID NO: 1168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucucucuacuccccucctt

SEQ ID NO: 1169 - RNA, 19 nt, Artificial Sequence
  source: /note="Description of Artificial Sequence: Synthetic oligonucleotide"
ggugacaacgaagccgacg

SEQ ID NO: 1170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugacaacgaagccgacgtt

SEQ ID NO: 1171 - RNA, 19 nt, Artificial Sequence
  source: /note="Description of Artificial Sequence: Synthetic oligonucleotide"
cgucggcuucguugucacc

SEQ ID NO: 1172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucggcuucguugucacctt

SEQ ID NO: 1173 - RNA, 19 nt, Artificial Sequence
  source: /note="Description of Artificial Sequence: Synthetic oligonucleotide"
gaagccgacggcagaggga

SEQ ID NO: 1174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagccgacggcagagggatt

SEQ ID NO: 1175 - RNA, 19 nt, Artificial Sequence
  source: /note="Description of Artificial Sequence: Synthetic oligonucleotide"
ucccucugccgucggcuuc

SEQ ID NO: 1176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucugccgucggcuuctt

SEQ ID NO: 1177 - RNA, 19 nt, Artificial Sequence
  source: /note="Description of Artificial Sequence: Synthetic oligonucleotide"
gccggagcccgaacggcgc

SEQ ID NO: 1178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccggagcccgaacggcgctt

SEQ ID NO: 1179 - RNA, 19 nt, Artificial Sequence
  source: /note="Description of Artificial Sequence: Synthetic oligonucleotide"
gcgccguucgggcuccggc

SEQ ID NO: 1180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgccguucgggcuccggctt

SEQ ID NO: 1181 - RNA, 19 nt, Artificial Sequence
  source: /note="Description of Artificial Sequence: Synthetic oligonucleotide"
cggccuggaagaggccgga

SEQ ID NO: 1182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccuggaagaggccggatt

SEQ ID NO: 1183 - RNA, 19 nt, Artificial Sequence
  source: /note="Description of Artificial Sequence: Synthetic oligonucleotide"
uccggccucuuccaggccg

SEQ ID NO: 1184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggccucuuccaggccgtt

SEQ ID NO: 1185 - RNA, 19 nt, Artificial Sequence
  source: /note="Description of Artificial Sequence: Synthetic oligonucleotide"
gcccaggaggcacuggcgg

SEQ ID NO: 1186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaggaggcacuggcggtt

SEQ ID NO: 1187 - RNA, 19 nt, Artificial Sequence
  source: /note="Description of Artificial Sequence: Synthetic oligonucleotide"
ccgccagugccuccugggc

SEQ ID NO: 1188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccagugccuccugggctt

SEQ ID NO: 1189 - RNA, 19 nt, Artificial Sequence
  source: /note="Description of Artificial Sequence: Synthetic oligonucleotide"
cgggaaagcgucagucggg

SEQ ID NO: 1190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggaaagcgucagucgggtt

SEQ ID NO: 1191 - RNA, 19 nt, Artificial Sequence
  source: /note="Description of Artificial Sequence: Synthetic oligonucleotide"
cccgacugacgcuuucccg

SEQ ID NO: 1192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgacugacgcuuucccgtt

SEQ ID NO: 1193 - RNA, 19 nt, Artificial Sequence
  source: /note="Description of Artificial Sequence: Synthetic oligonucleotide"
agcugggccgugacagcgg

SEQ ID NO: 1194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugggccgugacagcggtt

SEQ ID NO: 1195 - RNA, 19 nt, Artificial Sequence
  source: /note="Description of Artificial Sequence: Synthetic oligonucleotide"
ccgcugucacggcccagcu

SEQ ID NO: 1196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcugucacggcccagcutt

SEQ ID NO: 1197 - RNA, 19 nt, Artificial Sequence
  source: /note="Description of Artificial Sequence: Synthetic oligonucleotide"
gugaccacagugguagcca

SEQ ID NO: 1198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaccacagugguagccatt

SEQ ID NO: 1199 - RNA, 19 nt, Artificial Sequence
  source: /note="Description of Artificial Sequence: Synthetic oligonucleotide"
uggcuaccacuguggucac

SEQ ID NO: 1200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuaccacuguggucactt

SEQ ID NO: 1201 - RNA, 19 nt, Artificial Sequence
  source: /note="Description of Artificial Sequence: Synthetic oligonucleotide"
gugaggcugcgguacuuuu

SEQ ID NO: 1202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaggcugcgguacuuuutt

SEQ ID NO: 1203 - RNA, 19 nt, Artificial Sequence
  source: /note="Description of Artificial Sequence: Synthetic oligonucleotide"
aaaaguaccgcagccucac

SEQ ID NO: 1204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaguaccgcagccucactt

SEQ ID NO: 1205 - RNA, 19 nt, Artificial Sequence
  source: /note="Description of Artificial Sequence: Synthetic oligonucleotide"
guguggucggcuggcugug

SEQ ID NO: 1206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguggucggcuggcugugtt

SEQ ID NO: 1207 - RNA, 19 nt, Artificial Sequence
  source: /note="Description of Artificial Sequence: Synthetic oligonucleotide"
cacagccagccgaccacac

SEQ ID NO: 1208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagccagccgaccacactt

SEQ ID NO: 1209 - RNA, 19 nt, Artificial Sequence
  source: /note="Description of Artificial Sequence: Synthetic oligonucleotide"
uacuugcugagcuacuucu

SEQ ID NO: 1210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuugcugagcuacuucutt

SEQ ID NO: 1211 - RNA, 19 nt, Artificial Sequence
  source: /note="Description of Artificial Sequence: Synthetic oligonucleotide"
agaaguagcucagcaagua

SEQ ID NO: 1212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaguagcucagcaaguatt

SEQ ID NO: 1213 - RNA, 19 nt, Artificial Sequence
  source: /note="Description of Artificial Sequence: Synthetic oligonucleotide"
aagacaccaccugaggcca

SEQ ID NO: 1214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagacaccaccugaggccatt

SEQ ID NO: 1215 - RNA, 19 nt, Artificial Sequence
  source: /note="Description of Artificial Sequence: Synthetic oligonucleotide"
uggccucagguggugucuu

SEQ ID NO: 1216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccucagguggugucuutt

SEQ ID NO: 1217 - RNA, 19 nt, Artificial Sequence
  source: /note="Description of Artificial Sequence: Synthetic oligonucleotide"
cuacuggaguacacgccau

SEQ ID NO: 1218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacuggaguacacgccautt

SEQ ID NO: 1219 - RNA, 19 nt, Artificial Sequence
  source: /note="Description of Artificial Sequence: Synthetic oligonucleotide"
auggcguguacuccaguag

SEQ ID NO: 1220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcguguacuccaguagtt

SEQ ID NO: 1221 - RNA, 19 nt, Artificial Sequence
  source: /note="Description of Artificial Sequence: Synthetic oligonucleotide"
uggaguacacgccauccuc

SEQ ID NO: 1222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaguacacgccauccuctt

SEQ ID NO: 1223 - RNA, 19 nt, Artificial Sequence
  source: /note="Description of Artificial Sequence: Synthetic oligonucleotide"
gaggauggcguguacucca

SEQ ID NO: 1224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggauggcguguacuccatt

SEQ ID NO: 1225 - RNA, 19 nt, Artificial Sequence
  source: /note="Description of Artificial Sequence: Synthetic oligonucleotide"
ccucagcagccuaaccucu

SEQ ID NO: 1226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucagcagccuaaccucutt

SEQ ID NO: 1227 - RNA, 19 nt, Artificial Sequence
  source: /note="Description of Artificial Sequence: Synthetic oligonucleotide"
agagguuaggcugcugagg

SEQ ID NO: 1228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagguuaggcugcugaggtt

SEQ ID NO: 1229 - RNA, 19 nt, Artificial Sequence
  source: /note="Description of Artificial Sequence: Synthetic oligonucleotide"
gauuuuaacuguuuguagg

SEQ ID NO: 1230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuuuaacuguuuguaggtt

SEQ ID NO: 1231 - RNA, 19 nt, Artificial Sequence
  source: /note="Description of Artificial Sequence: Synthetic oligonucleotide"
ccuacaaacaguuaaaauc

SEQ ID NO: 1232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacaaacaguuaaaauctt

SEQ ID NO: 1233 - RNA, 19 nt, Artificial Sequence
  source: /note="Description of Artificial Sequence: Synthetic oligonucleotide"
cucccaggucccuuguaaa

SEQ ID NO: 1234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccaggucccuuguaaatt

SEQ ID NO: 1235 - RNA, 19 nt, Artificial Sequence
  source: /note="Description of Artificial Sequence: Synthetic oligonucleotide"
uuuacaagggaccugggag

SEQ ID NO: 1236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuacaagggaccugggagtt

SEQ ID NO: 1237 - RNA, 19 nt, Artificial Sequence
  source: /note="Description of Artificial Sequence: Synthetic oligonucleotide"
aggaggggaguagagagag

SEQ ID NO: 1238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaggggaguagagagagtt

SEQ ID NO: 1239 - RNA, 19 nt, Artificial Sequence
  source: /note="Description of Artificial Sequence: Synthetic oligonucleotide"
cucucucuacuccccuccu

SEQ ID NO: 1240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucucuacuccccuccutt

SEQ ID NO: 1241 - RNA, 19 nt, Artificial Sequence
  source: /note="Description of Artificial Sequence: Synthetic oligonucleotide"
guuuccacaguaagguuug

SEQ ID NO: 1242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuccacaguaagguuugtt

SEQ ID NO: 1243 - RNA, 19 nt, Artificial Sequence
  source: /note="Description of Artificial Sequence: Synthetic oligonucleotide"
caaaccuuacuguggaaac

SEQ ID NO: 1244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaccuuacuguggaaactt

SEQ ID NO: 1245 - RNA, 19 nt, Artificial Sequence
  source: /note="Description of Artificial Sequence: Synthetic oligonucleotide"
aacuauacggaguucaagu

SEQ ID NO: 1246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuauacggaguucaagutt

SEQ ID NO: 1247 - RNA, 19 nt, Artificial Sequence
  source: /note="Description of Artificial Sequence: Synthetic oligonucleotide"
acuugaacuccguauaguu

SEQ ID NO: 1248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugaacuccguauaguutt

SEQ ID NO: 1249 - RNA, 19 nt, Artificial Sequence
  source: /note="Description of Artificial Sequence: Synthetic oligonucleotide"
acuauacggaguucaaguu

SEQ ID NO: 1250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuauacggaguucaaguutt

SEQ ID NO: 1251 - RNA, 19 nt, Artificial Sequence
  source: /note="Description of Artificial Sequence: Synthetic oligonucleotide"
aacuugaacuccguauagu

SEQ ID NO: 1252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuugaacuccguauagutt

SEQ ID NO: 1253 - RNA, 19 nt, Artificial Sequence
  source: /note="Description of Artificial Sequence: Synthetic oligonucleotide"
ccgaacggcgcggccugga

SEQ ID NO: 1254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaacggcgcggccuggatt

SEQ ID NO: 1255 - RNA, 19 nt, Artificial Sequence
  source: /note="Description of Artificial Sequence: Synthetic oligonucleotide"
uccaggccgcgccguucgg

SEQ ID NO: 1256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaggccgcgccguucggtt

SEQ ID NO: 1257 - RNA, 19 nt, Artificial Sequence
  source: /note="Description of Artificial Sequence: Synthetic oligonucleotide"
agaaggacgagcuguauuu

SEQ ID NO: 1258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaggacgagcuguauuutt

SEQ ID NO: 1259 - RNA, 19 nt, Artificial Sequence
  source: /note="Description of Artificial Sequence: Synthetic oligonucleotide"
aaauacagcucguccuucu

SEQ ID NO: 1260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauacagcucguccuucutt

SEQ ID NO: 1261 - RNA, 19 nt, Artificial Sequence
  source: /note="Description of Artificial Sequence: Synthetic oligonucleotide"
auuacaccucguccaucga

SEQ ID NO: 1262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuacaccucguccaucgatt

SEQ ID NO: 1263 - RNA, 19 nt, Artificial Sequence
  source: /note="Description of Artificial Sequence: Synthetic oligonucleotide"
ucgauggacgagguguaau

SEQ ID NO: 1264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgauggacgagguguaautt

SEQ ID NO: 1265 - RNA, 19 nt, Artificial Sequence
  source: /note="Description of Artificial Sequence: Synthetic oligonucleotide"
aacgucaauucacaccauu

SEQ ID NO: 1266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgucaauucacaccauutt

SEQ ID NO: 1267 - RNA, 19 nt, Artificial Sequence
  source: /note="Description of Artificial Sequence: Synthetic oligonucleotide"
aauggugugaauugacguu

SEQ ID NO: 1268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggugugaauugacguutt

SEQ ID NO: 1269 - RNA, 19 nt, Artificial Sequence
  source: /note="Description of Artificial Sequence: Synthetic oligonucleotide"
gccgacggcagagggacuu

SEQ ID NO: 1270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgacggcagagggacuutt

SEQ ID NO: 1271 - RNA, 19 nt, Artificial Sequence
  source: /note="Description of Artificial Sequence: Synthetic oligonucleotide"
aagucccucugccgucggc

SEQ ID NO: 1272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagucccucugccgucggctt

SEQ ID NO: 1273 - RNA, 19 nt, Artificial Sequence
  source: /note="Description of Artificial Sequence: Synthetic oligonucleotide"
agcccgaacggcgcggccu

SEQ ID NO: 1274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccgaacggcgcggccutt

SEQ ID NO: 1275 - RNA, 19 nt, Artificial Sequence
  source: /note="Description of Artificial Sequence: Synthetic oligonucleotide"
aggccgcgccguucgggcu

SEQ ID NO: 1276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccgcgccguucgggcutt

SEQ ID NO: 1277 - RNA, 19 nt, Artificial Sequence
  source: /note="Description of Artificial Sequence: Synthetic oligonucleotide"
gcucggcgccaugagcggc

SEQ ID NO: 1278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucggcgccaugagcggctt

SEQ ID NO: 1279 - RNA, 19 nt, Artificial Sequence
  source: /note="Description of Artificial Sequence: Synthetic oligonucleotide"
gccgcucauggcgccgagc

SEQ ID NO: 1280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcucauggcgccgagctt

SEQ ID NO: 1281 - RNA, 19 nt, Artificial Sequence
  source: /note="Description of Artificial Sequence: Synthetic oligonucleotide"
caagaaccgagaacugcag

SEQ ID NO: 1282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagaaccgagaacugcagtt

SEQ ID NO: 1283 - RNA, 19 nt, Artificial Sequence
  source: /note="Description of Artificial Sequence: Synthetic oligonucleotide"
cugcaguucucgguucuug

SEQ ID NO: 1284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcaguucucgguucuugtt

SEQ ID NO: 1285 - RNA, 19 nt, Artificial Sequence
  source: /note="Description of Artificial Sequence: Synthetic oligonucleotide"
cgagacgguguaccgagug

SEQ ID NO: 1286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagacgguguaccgagugtt

SEQ ID NO: 1287 - RNA, 19 nt, Artificial Sequence
  source: /note="Description of Artificial Sequence: Synthetic oligonucleotide"
cacucgguacaccgucucg

SEQ ID NO: 1288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucgguacaccgucucgtt

SEQ ID NO: 1289 - RNA, 19 nt, Artificial Sequence
  source: /note="Description of Artificial Sequence: Synthetic oligonucleotide"
guucggggggagcccaaug

SEQ ID NO: 1290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucggggggagcccaaugtt

SEQ ID NO: 1291 - RNA, 19 nt, Artificial Sequence
  source: /note="Description of Artificial Sequence: Synthetic oligonucleotide"
cauugggcuccccccgaac

SEQ ID NO: 1292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauugggcuccccccgaactt

SEQ ID NO: 1293 - RNA, 19 nt, Artificial Sequence
  source: /note="Description of Artificial Sequence: Synthetic oligonucleotide"
gcucuagccuacuggagua

SEQ ID NO: 1294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuagccuacuggaguatt

SEQ ID NO: 1295 - RNA, 19 nt, Artificial Sequence
  source: /note="Description of Artificial Sequence: Synthetic oligonucleotide"
uacuccaguaggcuagagc

SEQ ID NO: 1296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccaguaggcuagagctt

SEQ ID NO: 1297 - RNA, 19 nt, Artificial Sequence
  source: /note="Description of Artificial Sequence: Synthetic oligonucleotide"
ccaacgaccgcccgcuucc

SEQ ID NO: 1298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaacgaccgcccgcuucctt

SEQ ID NO: 1299 - RNA, 19 nt, Artificial Sequence
  source: /note="Description of Artificial Sequence: Synthetic oligonucleotide"
ggaagcgggcggucguugg

SEQ ID NO: 1300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagcgggcggucguuggtt

SEQ ID NO: 1301 - RNA, 19 nt, Artificial Sequence
  source: /note="Description of Artificial Sequence: Synthetic oligonucleotide"
ggcaugaaacccuuaaaaa

SEQ ID NO: 1302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaugaaacccuuaaaaatt

SEQ ID NO: 1303 - RNA, 19 nt, Artificial Sequence
  source: /note="Description of Artificial Sequence: Synthetic oligonucleotide"
uuuuuaaggguuucaugcc

SEQ ID NO: 1304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuuaaggguuucaugcctt

SEQ ID NO: 1305 - RNA, 19 nt, Artificial Sequence
  source: /note="Description of Artificial Sequence: Synthetic oligonucleotide"
agccgacggcagagggacu

SEQ ID NO: 1306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccgacggcagagggacutt

SEQ ID NO: 1307 - RNA, 19 nt, Artificial Sequence
  source: /note="Description of Artificial Sequence: Synthetic oligonucleotide"
agucccucugccgucggcu

SEQ ID NO: 1308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucccucugccgucggcutt

SEQ ID NO: 1309 - RNA, 19 nt, Artificial Sequence
  source: /note="Description of Artificial Sequence: Synthetic oligonucleotide"
cgacggcagagggacuuca

SEQ ID NO: 1310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacggcagagggacuucatt

SEQ ID NO: 1311 - RNA, 19 nt, Artificial Sequence
  source: /note="Description of Artificial Sequence: Synthetic oligonucleotide"
ugaagucccucugccgucg

SEQ ID NO: 1312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaagucccucugccgucgtt

SEQ ID NO: 1313 - RNA, 19 nt, Artificial Sequence
  source: /note="Description of Artificial Sequence: Synthetic oligonucleotide"
gacggcagagggacuucau

SEQ ID NO: 1314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacggcagagggacuucautt

SEQ ID NO: 1315 - RNA, 19 nt, Artificial Sequence
  source: /note="Description of Artificial Sequence: Synthetic oligonucleotide"
augaagucccucugccguc

SEQ ID NO: 1316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaagucccucugccguctt

SEQ ID NO: 1317 - RNA, 19 nt, Artificial Sequence
  source: /note="Description of Artificial Sequence: Synthetic oligonucleotide"
gcccgaacggcgcggccug

SEQ ID NO: 1318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgaacggcgcggccugtt

SEQ ID NO: 1319 - RNA, 19 nt, Artificial Sequence
  source: /note="Description of Artificial Sequence: Synthetic oligonucleotide"
caggccgcgccguucgggc

SEQ ID NO: 1320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggccgcgccguucgggctt

SEQ ID NO: 1321 - RNA, 19 nt, Artificial Sequence
  source: /note="Description of Artificial Sequence: Synthetic oligonucleotide"
cgaacggcgcggccuggaa

SEQ ID NO: 1322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaacggcgcggccuggaatt

SEQ ID NO: 1323 - RNA, 19 nt, Artificial Sequence
  source: /note="Description of Artificial Sequence: Synthetic oligonucleotide"
uuccaggccgcgccguucg

SEQ ID NO: 1324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaggccgcgccguucgtt

SEQ ID NO: 1325 - RNA, 19 nt, Artificial Sequence
  source: /note="Description of Artificial Sequence: Synthetic oligonucleotide"
aacggcgcggccuggaaga

SEQ ID NO: 1326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacggcgcggccuggaagatt

SEQ ID NO: 1327 - RNA, 19 nt, Artificial Sequence
  source: /note="Description of Artificial Sequence: Synthetic oligonucleotide"
ucuuccaggccgcgccguu

SEQ ID NO: 1328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuccaggccgcgccguutt

SEQ ID NO: 1329 - RNA, 19 nt, Artificial Sequence
  source: /note="Description of Artificial Sequence: Synthetic oligonucleotide"
gcgcggccuggaagaggcc

SEQ ID NO: 1330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcggccuggaagaggcctt

SEQ ID NO: 1331 - RNA, 19 nt, Artificial Sequence
  source: /note="Description of Artificial Sequence: Synthetic oligonucleotide"
ggccucuuccaggccgcgc

SEQ ID NO: 1332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccucuuccaggccgcgctt

SEQ ID NO: 1333 - RNA, 19 nt, Artificial Sequence
  source: /note="Description of Artificial Sequence: Synthetic oligonucleotide"
cgcucggcgccaugagcgg

SEQ ID NO: 1334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcucggcgccaugagcggtt

SEQ ID NO: 1335 - RNA, 19 nt, Artificial Sequence
  source: /note="Description of Artificial Sequence: Synthetic oligonucleotide"
ccgcucauggcgccgagcg

SEQ ID NO: 1336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcucauggcgccgagcgtt

SEQ ID NO: 1337 - RNA, 19 nt, Artificial Sequence
  source: /note="Description of Artificial Sequence: Synthetic oligonucleotide"
cucggcgccaugagcggcg

SEQ ID NO: 1338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggcgccaugagcggcgtt

SEQ ID NO: 1339 - RNA, 19 nt, Artificial Sequence
  source: /note="Description of Artificial Sequence: Synthetic oligonucleotide"
cgccgcucauggcgccgag

SEQ ID NO: 1340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgcucauggcgccgagtt

SEQ ID NO: 1341 - RNA, 19 nt, Artificial Sequence
  source: /note="Description of Artificial Sequence: Synthetic oligonucleotide"
gccaugagcggcggcgggc

SEQ ID NO: 1342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaugagcggcggcgggctt

SEQ ID NO: 1343 - RNA, 19 nt, Artificial Sequence
  source: /note="Description of Artificial Sequence: Synthetic oligonucleotide"
gcccgccgccgcucauggc

SEQ ID NO: 1344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgccgccgcucauggctt

SEQ ID NO: 1345 - RNA, 19 nt, Artificial Sequence
  source: /note="Description of Artificial Sequence: Synthetic oligonucleotide"
caugagcggcggcgggccu

SEQ ID NO: 1346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugagcggcggcgggccutt

SEQ ID NO: 1347 - RNA, 19 nt, Artificial Sequence
  source: /note="Description of Artificial Sequence: Synthetic oligonucleotide"
aggcccgccgccgcucaug

SEQ ID NO: 1348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcccgccgccgcucaugtt

SEQ ID NO: 1349 - RNA, 19 nt, Artificial Sequence
  source: /note="Description of Artificial Sequence: Synthetic oligonucleotide"
guucgcggagccaggaggc

SEQ ID NO: 1350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucgcggagccaggaggctt

SEQ ID NO: 1351 - RNA, 19 nt, Artificial Sequence
  source: /note="Description of Artificial Sequence: Synthetic oligonucleotide"
gccuccuggcuccgcgaac

SEQ ID NO: 1352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuccuggcuccgcgaactt

SEQ ID NO: 1353 - RNA, 19 nt, Artificial Sequence
  source: /note="Description of Artificial Sequence: Synthetic oligonucleotide"
uucgcggagccaggaggcg

SEQ ID NO: 1354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucgcggagccaggaggcgtt

SEQ ID NO: 1355 - RNA, 19 nt, Artificial Sequence
  source: /note="Description of Artificial Sequence: Synthetic oligonucleotide"
cgccuccuggcuccgcgaa

SEQ ID NO: 1356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccuccuggcuccgcgaatt

SEQ ID NO: 1357 - RNA, 19 nt, Artificial Sequence
  source: /note="Description of Artificial Sequence: Synthetic oligonucleotide"
cggcgcgggcacuagcuuc

SEQ ID NO: 1358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgcgggcacuagcuuctt

SEQ ID NO: 1359 - RNA, 19 nt, Artificial Sequence
  source: /note="Description of Artificial Sequence: Synthetic oligonucleotide"
gaagcuagugcccgcgccg

SEQ ID NO: 1360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcuagugcccgcgccgtt

SEQ ID NO: 1361 - RNA, 19 nt, Artificial Sequence
  source: /note="Description of Artificial Sequence: Synthetic oligonucleotide"
gcgcgggcacuagcuuccc

SEQ ID NO: 1362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcgggcacuagcuuccctt

SEQ ID NO: 1363 - RNA, 19 nt, Artificial Sequence
  source: /note="Description of Artificial Sequence: Synthetic oligonucleotide"
gggaagcuagugcccgcgc

SEQ ID NO: 1364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagcuagugcccgcgctt

SEQ ID NO: 1365 - RNA, 19 nt, Artificial Sequence
  source: /note="Description of Artificial Sequence: Synthetic oligonucleotide"
acuagcuucccgccgccgg

SEQ ID NO: 1366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuagcuucccgccgccggtt

SEQ ID NO: 1367 - RNA, 19 nt, Artificial Sequence
  source: /note="Description of Artificial Sequence: Synthetic oligonucleotide"
ccggcggcgggaagcuagu

SEQ ID NO: 1368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcggcgggaagcuagutt

SEQ ID NO: 1369 - RNA, 19 nt, Artificial Sequence
  source: /note="Description of Artificial Sequence: Synthetic oligonucleotide"
cuagcuucccgccgccggg

SEQ ID NO: 1370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagcuucccgccgccgggtt

SEQ ID NO: 1371 - RNA, 19 nt, Artificial Sequence
  source: /note="Description of Artificial Sequence: Synthetic oligonucleotide"
cccggcggcgggaagcuag

SEQ ID NO: 1372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggcggcgggaagcuagtt

SEQ ID NO: 1373 - RNA, 19 nt, Artificial Sequence
  source: /note="Description of Artificial Sequence: Synthetic oligonucleotide"
cuucccgccgccgggagug

SEQ ID NO: 1374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccgccgccgggagugtt

SEQ ID NO: 1375 - RNA, 19 nt, Artificial Sequence
  source: /note="Description of Artificial Sequence: Synthetic oligonucleotide"
cacucccggcggcgggaag

SEQ ID NO: 1376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucccggcggcgggaagtt

SEQ ID NO: 1377 - RNA, 19 nt, Artificial Sequence
  source: /note="Description of Artificial Sequence: Synthetic oligonucleotide"
ccgugacagcgggaaggug

SEQ ID NO: 1378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgugacagcgggaaggugtt

SEQ ID NO: 1379 - RNA, 19 nt, Artificial Sequence
  source: /note="Description of Artificial Sequence: Synthetic oligonucleotide"
caccuucccgcugucacgg

SEQ ID NO: 1380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuucccgcugucacggtt

SEQ ID NO: 1381 - RNA, 19 nt, Artificial Sequence
  source: /note="Description of Artificial Sequence: Synthetic oligonucleotide"
cccaagaaguggcuuacac

SEQ ID NO: 1382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaagaaguggcuuacactt

SEQ ID NO: 1383 - RNA, 19 nt, Artificial Sequence
  source: /note="Description of Artificial Sequence: Synthetic oligonucleotide"
guguaagccacuucuuggg

SEQ ID NO: 1384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguaagccacuucuugggtt

SEQ ID NO: 1385 - RNA, 19 nt, Artificial Sequence
  source: /note="Description of Artificial Sequence: Synthetic oligonucleotide"
ucggaguaguauaccaggc

SEQ ID NO: 1386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggaguaguauaccaggctt

SEQ ID NO: 1387 - RNA, 19 nt, Artificial Sequence
  source: /note="Description of Artificial Sequence: Synthetic oligonucleotide"
gccugguauacuacuccga

SEQ ID NO: 1388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugguauacuacuccgatt

SEQ ID NO: 1389 - RNA, 19 nt, Artificial Sequence
  source: /note="Description of Artificial Sequence: Synthetic oligonucleotide"
uauaccaggcacggcuggc

SEQ ID NO: 1390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaccaggcacggcuggctt

SEQ ID NO: 1391 - RNA, 19 nt, Artificial Sequence
  source: /note="Description of Artificial Sequence: Synthetic oligonucleotide"
gccagccgugccugguaua

SEQ ID NO: 1392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagccgugccugguauatt

SEQ ID NO: 1393 - RNA, 19 nt, Artificial Sequence
  source: /note="Description of Artificial Sequence: Synthetic oligonucleotide"
cacggcuggcagagacgag

SEQ ID NO: 1394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacggcuggcagagacgagtt

SEQ ID NO: 1395 - RNA, 19 nt, Artificial Sequence
  source: /note="Description of Artificial Sequence: Synthetic oligonucleotide"
cucgucucugccagccgug

SEQ ID NO: 1396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgucucugccagccgugtt

SEQ ID NO: 1397 - RNA, 19 nt, Artificial Sequence
  source: /note="Description of Artificial Sequence: Synthetic oligonucleotide"
accccuaucaucuacauca

SEQ ID NO: 1398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accccuaucaucuacaucatt

SEQ ID NO: 1399 - RNA, 19 nt, Artificial Sequence
  source: /note="Description of Artificial Sequence: Synthetic oligonucleotide"
ugauguagaugauaggggu

SEQ ID NO: 1400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauguagaugauaggggutt

SEQ ID NO: 1401 - RNA, 19 nt, Artificial Sequence
  source: /note="Description of Artificial Sequence: Synthetic oligonucleotide"
ccccuaucaucuacaucaa

SEQ ID NO: 1402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuaucaucuacaucaatt

SEQ ID NO: 1403 - RNA, 19 nt, Artificial Sequence
  source: /note="Description of Artificial Sequence: Synthetic oligonucleotide"
uugauguagaugauagggg

SEQ ID NO: 1404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugauguagaugauaggggtt

SEQ ID NO: 1405 - RNA, 19 nt, Artificial Sequence
  source: /note="Description of Artificial Sequence: Synthetic oligonucleotide"
cccuaucaucuacaucaag

SEQ ID NO: 1406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuaucaucuacaucaagtt

SEQ ID NO: 1407 - RNA, 19 nt, Artificial Sequence
  source: /note="Description of Artificial Sequence: Synthetic oligonucleotide"
cuugauguagaugauaggg

SEQ ID NO: 1408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugauguagaugauagggtt

SEQ ID NO: 1409 - RNA, 19 nt, Artificial Sequence
  source: /note="Description of Artificial Sequence: Synthetic oligonucleotide"
acaucaagccccagaauuu

SEQ ID NO: 1410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucaagccccagaauuutt

SEQ ID NO: 1411 - RNA, 19 nt, Artificial Sequence
  source: /note="Description of Artificial Sequence: Synthetic oligonucleotide"
aaauucuggggcuugaugu

SEQ ID NO: 1412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauucuggggcuugaugutt

SEQ ID NO: 1413 - RNA, 19 nt, Artificial Sequence
  source: /note="Description of Artificial Sequence: Synthetic oligonucleotide"
caucaagccccagaauuug

SEQ ID NO: 1414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagccccagaauuugtt

SEQ ID NO: 1415 - RNA, 19 nt, Artificial Sequence
  source: /note="Description of Artificial Sequence: Synthetic oligonucleotide"
caaauucuggggcuugaug

SEQ ID NO: 1416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauucuggggcuugaugtt

SEQ ID NO: 1417 - RNA, 19 nt, Artificial Sequence
  source: /note="Description of Artificial Sequence: Synthetic oligonucleotide"
agcccaauguguccuacau

SEQ ID NO: 1418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaauguguccuacautt

SEQ ID NO: 1419 - RNA, 19 nt, Artificial Sequence
  source: /note="Description of Artificial Sequence: Synthetic oligonucleotide"
auguaggacacauugggcu

SEQ ID NO: 1420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguaggacacauugggcutt

SEQ ID NO: 1421 - RNA, 19 nt, Artificial Sequence
  source: /note="Description of Artificial Sequence: Synthetic oligonucleotide"
cccaauguguccuacaucu

SEQ ID NO: 1422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaauguguccuacaucutt

SEQ ID NO: 1423 - RNA, 19 nt, Artificial Sequence
  source: /note="Description of Artificial Sequence: Synthetic oligonucleotide"
agauguaggacacauuggg

SEQ ID NO: 1424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauguaggacacauugggtt

SEQ ID NO: 1425 - RNA, 19 nt, Artificial Sequence
  source: /note="Description of Artificial Sequence: Synthetic oligonucleotide"
ccgugcuccagaacucauc

SEQ ID NO: 1426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgugcuccagaacucauctt

SEQ ID NO: 1427 - RNA, 19 nt, Artificial Sequence
  source: /note="Description of Artificial Sequence: Synthetic oligonucleotide"
gaugaguucuggagcacgg

SEQ ID NO: 1428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaguucuggagcacggtt

SEQ ID NO: 1429 - RNA, 19 nt, Artificial Sequence
  source: /note="Description of Artificial Sequence: Synthetic oligonucleotide"
gaacucaucuuuggagcca

SEQ ID NO: 1430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacucaucuuuggagccatt

SEQ ID NO: 1431 - RNA, 19 nt, Artificial Sequence
  source: /note="Description of Artificial Sequence: Synthetic oligonucleotide"
uggcuccaaagaugaguuc

SEQ ID NO: 1432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuccaaagaugaguuctt

SEQ ID NO: 1433 - RNA, 19 nt, Artificial Sequence
  source: /note="Description of Artificial Sequence: Synthetic oligonucleotide"
guccaucgauguguggucg

SEQ ID NO: 1434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaucgauguguggucgtt

SEQ ID NO: 1435 - RNA, 19 nt, Artificial Sequence
  source: /note="Description of Artificial Sequence: Synthetic oligonucleotide"
cgaccacacaucgauggac

SEQ ID NO: 1436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaccacacaucgauggactt

SEQ ID NO: 1437 - RNA, 19 nt, Artificial Sequence
  source: /note="Description of Artificial Sequence: Synthetic oligonucleotide"
cugagcuacuucucggcca

SEQ ID NO: 1438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugagcuacuucucggccatt

SEQ ID NO: 1439 - RNA, 19 nt, Artificial Sequence
  source: /note="Description of Artificial Sequence: Synthetic oligonucleotide"
uggccgagaaguagcucag

SEQ ID NO: 1440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccgagaaguagcucagtt

SEQ ID NO: 1441 - RNA, 19 nt, Artificial Sequence
  source: /note="Description of Artificial Sequence: Synthetic oligonucleotide"
gaacccuaacuauacggag

SEQ ID NO: 1442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacccuaacuauacggagtt

SEQ ID NO: 1443 - RNA, 19 nt, Artificial Sequence
  source: /note="Description of Artificial Sequence: Synthetic oligonucleotide"
cuccguauaguuaggguuc

SEQ ID NO: 1444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccguauaguuaggguuctt

SEQ ID NO: 1445 - RNA, 19 nt, Artificial Sequence
  source: /note="Description of Artificial Sequence: Synthetic oligonucleotide"
aagguguucaaaucuucaa

SEQ ID NO: 1446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguguucaaaucuucaatt

SEQ ID NO: 1447 - RNA, 19 nt, Artificial Sequence
  source: /note="Description of Artificial Sequence: Synthetic oligonucleotide"
uugaagauuugaacaccuu

SEQ ID NO: 1448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaagauuugaacaccuutt

SEQ ID NO: 1449 - RNA, 19 nt, Artificial Sequence
  source: /note="Description of Artificial Sequence: Synthetic oligonucleotide"
ggccauugcacucugcucu

SEQ ID NO: 1450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccauugcacucugcucutt

SEQ ID NO: 1451 - RNA, 19 nt, Artificial Sequence
  source: /note="Description of Artificial Sequence: Synthetic oligonucleotide"
agagcagagugcaauggcc

SEQ ID NO: 1452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcagagugcaauggcctt

SEQ ID NO: 1453 - RNA, 19 nt, Artificial Sequence
  source: /note="Description of Artificial Sequence: Synthetic oligonucleotide"
guacacgccauccucaagg

SEQ ID NO: 1454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacacgccauccucaaggtt

SEQ ID NO: 1455 - RNA, 19 nt, Artificial Sequence
  source: /note="Description of Artificial Sequence: Synthetic oligonucleotide"
ccuugaggauggcguguac

SEQ ID NO: 1456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugaggauggcguguactt

SEQ ID NO: 1457 - RNA, 19 nt, Artificial Sequence
  source: /note="Description of Artificial Sequence: Synthetic oligonucleotide"
acugcggagacucggagcc

SEQ ID NO: 1458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcggagacucggagcctt

SEQ ID NO: 1459 - RNA, 19 nt, Artificial Sequence
  source: /note="Description of Artificial Sequence: Synthetic oligonucleotide"
ggcuccgagucuccgcagu

SEQ ID NO: 1460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccgagucuccgcagutt

SEQ ID NO: 1461 - RNA, 19 nt, Artificial Sequence
  source: /note="Description of Artificial Sequence: Synthetic oligonucleotide"
cugcggagacucggagccc

SEQ ID NO: 1462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcggagacucggagccctt

SEQ ID NO: 1463 - RNA, 19 nt, Artificial Sequence
  source: /note="Description of Artificial Sequence: Synthetic oligonucleotide"
gggcuccgagucuccgcag

SEQ ID NO: 1464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuccgagucuccgcagtt

SEQ ID NO: 1465 - RNA, 19 nt, Artificial Sequence
  source: /note="Description of Artificial Sequence: Synthetic oligonucleotide"
gcuucccccccuguucaac

SEQ ID NO: 1466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucccccccuguucaactt

SEQ ID NO: 1467 - RNA, 19 nt, Artificial Sequence
  source: /note="Description of Artificial Sequence: Synthetic oligonucleotide"
guugaacagggggggaagc

SEQ ID NO: 1468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugaacagggggggaagctt

SEQ ID NO: 1469 - RNA, 19 nt, Artificial Sequence
  source: /note="Description of Artificial Sequence: Synthetic oligonucleotide"
cuucccccccuguucaacu

SEQ ID NO: 1470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccccccuguucaacutt

SEQ ID NO: 1471 - RNA, 19 nt, Artificial Sequence
  source: /note="Description of Artificial Sequence: Synthetic oligonucleotide"
aguugaacagggggggaag

SEQ ID NO: 1472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguugaacagggggggaagtt

SEQ ID NO: 1473 - RNA, 19 nt, Artificial Sequence
  source: /note="Description of Artificial Sequence: Synthetic oligonucleotide"
uucccccccuguucaacuu

SEQ ID NO: 1474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccccccuguucaacuutt

SEQ ID NO: 1475 - RNA, 19 nt, Artificial Sequence
  source: /note="Description of Artificial Sequence: Synthetic oligonucleotide"
aaguugaacagggggggaa

SEQ ID NO: 1476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguugaacagggggggaatt

SEQ ID NO: 1477 - RNA, 19 nt, Artificial Sequence
  source: /note="Description of Artificial Sequence: Synthetic oligonucleotide"
ccuacaacccauccucaca

SEQ ID NO: 1478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacaacccauccucacatt

SEQ ID NO: 1479 - RNA, 19 nt, Artificial Sequence
  source: /note="Description of Artificial Sequence: Synthetic oligonucleotide"
ugugaggauggguuguagg

SEQ ID NO: 1480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugaggauggguuguaggtt

SEQ ID NO: 1481 - RNA, 19 nt, Artificial Sequence
  source: /note="Description of Artificial Sequence: Synthetic oligonucleotide"
acaagcuuuaacugaagcu

SEQ ID NO: 1482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagcuuuaacugaagcutt

SEQ ID NO: 1483 - RNA, 19 nt, Artificial Sequence
  source: /note="Description of Artificial Sequence: Synthetic oligonucleotide"
agcuucaguuaaagcuugu

SEQ ID NO: 1484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuucaguuaaagcuugutt

SEQ ID NO: 1485 - RNA, 19 nt, Artificial Sequence
  source: /note="Description of Artificial Sequence: Synthetic oligonucleotide"
gaagcucagacuggccaag

SEQ ID NO: 1486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcucagacuggccaagtt

SEQ ID NO: 1487 - RNA, 19 nt, Artificial Sequence
  source: /note="Description of Artificial Sequence: Synthetic oligonucleotide"
cuuggccagucugagcuuc

SEQ ID NO: 1488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggccagucugagcuuctt

SEQ ID NO: 1489 - RNA, 19 nt, Artificial Sequence
  source: /note="Description of Artificial Sequence: Synthetic oligonucleotide"
ggccaagauuggcagccau

SEQ ID NO: 1490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaagauuggcagccautt

SEQ ID NO: 1491 - RNA, 19 nt, Artificial Sequence
  source: /note="Description of Artificial Sequence: Synthetic oligonucleotide"
auggcugccaaucuuggcc

SEQ ID NO: 1492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcugccaaucuuggcctt

SEQ ID NO: 1493 - RNA, 19 nt, Artificial Sequence
  source: /note="Description of Artificial Sequence: Synthetic oligonucleotide"
acugcuacccucgcuagcu

SEQ ID NO: 1494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcuacccucgcuagcutt

SEQ ID NO: 1495 - RNA, 19 nt, Artificial Sequence
  source: /note="Description of Artificial Sequence: Synthetic oligonucleotide"
agcuagcgaggguagcagu

SEQ ID NO: 1496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuagcgaggguagcagutt

SEQ ID NO: 1497 - RNA, 19 nt, Artificial Sequence
  source: /note="Description of Artificial Sequence: Synthetic oligonucleotide"
uuaacuguuuguaggggag

SEQ ID NO: 1498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaacuguuuguaggggagtt

SEQ ID NO: 1499 - RNA, 19 nt, Artificial Sequence
  source: /note="Description of Artificial Sequence: Synthetic oligonucleotide"
cuccccuacaaacaguuaa

SEQ ID NO: 1500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccuacaaacaguuaatt

SEQ ID NO: 1501 - RNA, 19 nt, Artificial Sequence
  source: /note="Description of Artificial Sequence: Synthetic oligonucleotide"
cuuguaaauagaaccagcc

SEQ ID NO: 1502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguaaauagaaccagcctt

SEQ ID NO: 1503 - RNA, 19 nt, Artificial Sequence
  source: /note="Description of Artificial Sequence: Synthetic oligonucleotide"
ggcugguucuauuuacaag

SEQ ID NO: 1504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugguucuauuuacaagtt

SEQ ID NO: 1505 - RNA, 19 nt, Artificial Sequence
  source: /note="Description of Artificial Sequence: Synthetic oligonucleotide"
ggguguaaauagauuguua

SEQ ID NO: 1506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguguaaauagauuguuatt

SEQ ID NO: 1507 - RNA, 19 nt, Artificial Sequence
  source: /note="Description of Artificial Sequence: Synthetic oligonucleotide"
uaacaaucuauuuacaccc

SEQ ID NO: 1508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacaaucuauuuacaccctt

SEQ ID NO: 1509 - RNA, 19 nt, Artificial Sequence
  source: /note="Description of Artificial Sequence: Synthetic oligonucleotide"
uguaaauagauuguuauaa

SEQ ID NO: 1510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaaauagauuguuauaatt

SEQ ID NO: 1511 - RNA, 19 nt, Artificial Sequence
  source: /note="Description of Artificial Sequence: Synthetic oligonucleotide"
uuauaacaaucuauuuaca

SEQ ID NO: 1512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauaacaaucuauuuacatt

SEQ ID NO: 1513 - RNA, 19 nt, Artificial Sequence
  source: /note="Description of Artificial Sequence: Synthetic oligonucleotide"
auucaacuugcccccccca

SEQ ID NO: 1514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucaacuugccccccccatt

SEQ ID NO: 1515 - RNA, 19 nt, Artificial Sequence
  source: /note="Description of Artificial Sequence: Synthetic oligonucleotide"
uggggggggcaaguugaau

SEQ ID NO: 1516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggggggcaaguugaautt

SEQ ID NO: 1517 - RNA, 19 nt, Artificial Sequence
  source: /note="Description of Artificial Sequence: Synthetic oligonucleotide"
uucaacuugccccccccag

SEQ ID NO: 1518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaacuugccccccccagtt

SEQ ID NO: 1519 - RNA, 19 nt, Artificial Sequence
  source: /note="Description of Artificial Sequence: Synthetic oligonucleotide"
cuggggggggcaaguugaa

SEQ ID NO: 1520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggggggcaaguugaatt

SEQ ID NO: 1521 - RNA, 19 nt, Artificial Sequence
  source: /note="Description of Artificial Sequence: Synthetic oligonucleotide"
guagagagagucccuggug

SEQ ID NO: 1522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagagagagucccuggugtt

SEQ ID NO: 1523 - RNA, 19 nt, Artificial Sequence
  source: /note="Description of Artificial Sequence: Synthetic oligonucleotide"
caccagggacucucucuac

SEQ ID NO: 1524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccagggacucucucuactt

SEQ ID NO: 1525 - RNA, 19 nt, Artificial Sequence
  source: /note="Description of Artificial Sequence: Synthetic oligonucleotide"
ugccuguguacagaccucu

SEQ ID NO: 1526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccuguguacagaccucutt

SEQ ID NO: 1527 - RNA, 19 nt, Artificial Sequence
  source: /note="Description of Artificial Sequence: Synthetic oligonucleotide"
agaggucuguacacaggca

SEQ ID NO: 1528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggucuguacacaggcatt

SEQ ID NO: 1529 - RNA, 19 nt, Artificial Sequence
  source: /note="Description of Artificial Sequence: Synthetic oligonucleotide"
acagaccucuguucaauaa

SEQ ID NO: 1530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagaccucuguucaauaatt

SEQ ID NO: 1531 - RNA, 19 nt, Artificial Sequence
  source: /note="Description of Artificial Sequence: Synthetic oligonucleotide"
uuauugaacagaggucugu

SEQ ID NO: 1532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauugaacagaggucugutt

SEQ ID NO: 1533 - RNA, 19 nt, Artificial Sequence
  source: /note="Description of Artificial Sequence: Synthetic oligonucleotide"
ccaugagcggcggcgggcc

SEQ ID NO: 1534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaugagcggcggcgggcctt

SEQ ID NO: 1535 - RNA, 19 nt, Artificial Sequence
  source: /note="Description of Artificial Sequence: Synthetic oligonucleotide"
ggcccgccgccgcucaugg

SEQ ID NO: 1536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccgccgccgcucauggtt

SEQ ID NO: 1537 - RNA, 19 nt, Artificial Sequence
  source: /note="Description of Artificial Sequence: Synthetic oligonucleotide"
cucgagcuccggggguggc

SEQ ID NO: 1538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgagcuccggggguggctt

SEQ ID NO: 1539 - RNA, 19 nt, Artificial Sequence
  source: /note="Description of Artificial Sequence: Synthetic oligonucleotide"
gccacccccggagcucgag

SEQ ID NO: 1540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacccccggagcucgagtt

SEQ ID NO: 1541 - RNA, 19 nt, Artificial Sequence
  source: /note="Description of Artificial Sequence: Synthetic oligonucleotide"
ugggccgugacagcgggaa

SEQ ID NO: 1542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccgugacagcgggaatt

SEQ ID NO: 1543 - RNA, 19 nt, Artificial Sequence
  source: /note="Description of Artificial Sequence: Synthetic oligonucleotide"
uucccgcugucacggccca

SEQ ID NO: 1544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccgcugucacggcccatt

SEQ ID NO: 1545 - RNA, 19 nt, Artificial Sequence
  source: /note="Description of Artificial Sequence: Synthetic oligonucleotide"
auaccaggcacggcuggca

SEQ ID NO: 1546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaccaggcacggcuggcatt

SEQ ID NO: 1547 - RNA, 19 nt, Artificial Sequence
  source: /note="Description of Artificial Sequence: Synthetic oligonucleotide"
ugccagccgugccugguau

SEQ ID NO: 1548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccagccgugccugguautt

SEQ ID NO: 1549 - RNA, 19 nt, Artificial Sequence
  source: /note="Description of Artificial Sequence: Synthetic oligonucleotide"
ucaagaaccgagaacugca

SEQ ID NO: 1550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagaaccgagaacugcatt

SEQ ID NO: 1551 - RNA, 19 nt, Artificial Sequence
  source: /note="Description of Artificial Sequence: Synthetic oligonucleotide"
ugcaguucucgguucuuga

SEQ ID NO: 1552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaguucucgguucuugatt

SEQ ID NO: 1553 - RNA, 19 nt, Artificial Sequence
  source: /note="Description of Artificial Sequence: Synthetic oligonucleotide"
gcugguucggggggagccc

SEQ ID NO: 1554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguucggggggagccctt

SEQ ID NO: 1555 - RNA, 19 nt, Artificial Sequence
  source: /note="Description of Artificial Sequence: Synthetic oligonucleotide"
gggcuccccccgaaccagc

SEQ ID NO: 1556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuccccccgaaccagctt

SEQ ID NO: 1557 - RNA, 19 nt, Artificial Sequence
  source: /note="Description of Artificial Sequence: Synthetic oligonucleotide"
cugguucggggggagccca

SEQ ID NO: 1558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguucggggggagcccatt

SEQ ID NO: 1559 - RNA, 19 nt, Artificial Sequence
  source: /note="Description of Artificial Sequence: Synthetic oligonucleotide"
ugggcuccccccgaaccag

SEQ ID NO: 1560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuccccccgaaccagtt

SEQ ID NO: 1561 - RNA, 19 nt, Artificial Sequence
  source: /note="Description of Artificial Sequence: Synthetic oligonucleotide"
cuacaucugcucucgguac

SEQ ID NO: 1562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaucugcucucgguactt

SEQ ID NO: 1563 - RNA, 19 nt, Artificial Sequence
  source: /note="Description of Artificial Sequence: Synthetic oligonucleotide"
guaccgagagcagauguag

SEQ ID NO: 1564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccgagagcagauguagtt

SEQ ID NO: 1565 - RNA, 19 nt, Artificial Sequence
  source: /note="Description of Artificial Sequence: Synthetic oligonucleotide"
cacucugcucuagccuacu

SEQ ID NO: 1566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucugcucuagccuacutt

SEQ ID NO: 1567 - RNA, 19 nt, Artificial Sequence
  source: /note="Description of Artificial Sequence: Synthetic oligonucleotide"
aguaggcuagagcagagug

SEQ ID NO: 1568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaggcuagagcagagugtt

SEQ ID NO: 1569 - RNA, 19 nt, Artificial Sequence
  source: /note="Description of Artificial Sequence: Synthetic oligonucleotide"
gacucggagcccagcuccc

SEQ ID NO: 1570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacucggagcccagcuccctt

SEQ ID NO: 1571 - RNA, 19 nt, Artificial Sequence
  source: /note="Description of Artificial Sequence: Synthetic oligonucleotide"
gggagcugggcuccgaguc

SEQ ID NO: 1572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagcugggcuccgaguctt

SEQ ID NO: 1573 - RNA, 19 nt, Artificial Sequence
  source: /note="Description of Artificial Sequence: Synthetic oligonucleotide"
cugaagcucagacuggcca

SEQ ID NO: 1574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaagcucagacuggccatt

SEQ ID NO: 1575 - RNA, 19 nt, Artificial Sequence
  source: /note="Description of Artificial Sequence: Synthetic oligonucleotide"
uggccagucugagcuucag

SEQ ID NO: 1576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccagucugagcuucagtt

SEQ ID NO: 1577 - RNA, 19 nt, Artificial Sequence
  source: /note="Description of Artificial Sequence: Synthetic oligonucleotide"
gccuguguacagaccucug

SEQ ID NO: 1578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuguguacagaccucugtt

SEQ ID NO: 1579 - RNA, 19 nt, Artificial Sequence
  source: /note="Description of Artificial Sequence: Synthetic oligonucleotide"
cagaggucuguacacaggc

SEQ ID NO: 1580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaggucuguacacaggctt

SEQ ID NO: 1581 - RNA, 19 nt, Artificial Sequence
  source: /note="Description of Artificial Sequence: Synthetic oligonucleotide"
ucccccccuguucaacuuc

SEQ ID NO: 1582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccccccuguucaacuuctt

SEQ ID NO: 1583 - RNA, 19 nt, Artificial Sequence
  source: /note="Description of Artificial Sequence: Synthetic oligonucleotide"
gaaguugaacaggggggga

SEQ ID NO: 1584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaguugaacagggggggatt

SEQ ID NO: 1585 - RNA, 19 nt, Artificial Sequence
  source: /note="Description of Artificial Sequence: Synthetic oligonucleotide"
acuuccuacaacccauccu

SEQ ID NO: 1586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuccuacaacccauccutt

SEQ ID NO: 1587 - RNA, 19 nt, Artificial Sequence
  source: /note="Description of Artificial Sequence: Synthetic oligonucleotide"
aggauggguuguaggaagu

SEQ ID NO: 1588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggauggguuguaggaagutt

SEQ ID NO: 1589 - RNA, 19 nt, Artificial Sequence
  source: /note="Description of Artificial Sequence: Synthetic oligonucleotide"
uggccaagauuggcagcca

SEQ ID NO: 1590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccaagauuggcagccatt

SEQ ID NO: 1591 - RNA, 19 nt, Artificial Sequence
  source: /note="Description of Artificial Sequence: Synthetic oligonucleotide"
uggcugccaaucuuggcca

SEQ ID NO: 1592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcugccaaucuuggccatt

SEQ ID NO: 1593 - RNA, 19 nt, Artificial Sequence
  source: /note="Description of Artificial Sequence: Synthetic oligonucleotide"
cccaggcuaccacuccuuc

SEQ ID NO: 1594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggcuaccacuccuuctt

SEQ ID NO: 1595 - RNA, 19 nt, Artificial Sequence
  source: /note="Description of Artificial Sequence: Synthetic oligonucleotide"
gaaggagugguagccuggg

SEQ ID NO: 1596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggagugguagccugggtt

SEQ ID NO: 1597 - RNA, 19 nt, Artificial Sequence
  source: /note="Description of Artificial Sequence: Synthetic oligonucleotide"
cggagcccgaacggcgcgg

SEQ ID NO: 1598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagcccgaacggcgcggtt

SEQ ID NO: 1599 - RNA, 19 nt, Artificial Sequence
  source: /note="Description of Artificial Sequence: Synthetic oligonucleotide"
ccgcgccguucgggcuccg

SEQ ID NO: 1600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcgccguucgggcuccgtt

SEQ ID NO: 1601 - RNA, 19 nt, Artificial Sequence
  source: /note="Description of Artificial Sequence: Synthetic oligonucleotide"
ggagcccgaacggcgcggc

SEQ ID NO: 1602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcccgaacggcgcggctt

SEQ ID NO: 1603 - RNA, 19 nt, Artificial Sequence
  source: /note="Description of Artificial Sequence: Synthetic oligonucleotide"
gccgcgccguucgggcucc

SEQ ID NO: 1604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcgccguucgggcucctt

SEQ ID NO: 1605 - RNA, 19 nt, Artificial Sequence
  source: /note="Description of Artificial Sequence: Synthetic oligonucleotide"
cggcgcggccuggaagagg

SEQ ID NO: 1606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgcggccuggaagaggtt

SEQ ID NO: 1607 - RNA, 19 nt, Artificial Sequence
  source: /note="Description of Artificial Sequence: Synthetic oligonucleotide"
ccucuuccaggccgcgccg

SEQ ID NO: 1608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuuccaggccgcgccgtt

SEQ ID NO: 1609 - RNA, 19 nt, Artificial Sequence
  source: /note="Description of Artificial Sequence: Synthetic oligonucleotide"
ggcgcggccuggaagaggc

SEQ ID NO: 1610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcggccuggaagaggctt

SEQ ID NO: 1611 - RNA, 19 nt, Artificial Sequence
  source: /note="Description of Artificial Sequence: Synthetic oligonucleotide"
gccucuuccaggccgcgcc

SEQ ID NO: 1612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucuuccaggccgcgcctt

SEQ ID NO: 1613 - RNA, 19 nt, Artificial Sequence
  source: /note="Description of Artificial Sequence: Synthetic oligonucleotide"
cgggccuucgggaggcggc

SEQ ID NO: 1614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggccuucgggaggcggctt

SEQ ID NO: 1615 - RNA, 19 nt, Artificial Sequence
  source: /note="Description of Artificial Sequence: Synthetic oligonucleotide"
gccgccucccgaaggcccg

SEQ ID NO: 1616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccucccgaaggcccgtt

SEQ ID NO: 1617 - RNA, 19 nt, Artificial Sequence
  source: /note="Description of Artificial Sequence: Synthetic oligonucleotide"
gccuucgggaggcggcccu

SEQ ID NO: 1618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuucgggaggcggcccutt

SEQ ID NO: 1619 - RNA, 19 nt, Artificial Sequence
  source: /note="Description of Artificial Sequence: Synthetic oligonucleotide"
agggccgccucccgaaggc

SEQ ID NO: 1620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggccgccucccgaaggctt

SEQ ID NO: 1621 - RNA, 19 nt, Artificial Sequence
  source: /note="Description of Artificial Sequence: Synthetic oligonucleotide"
cuucgggaggcggcccugg

SEQ ID NO: 1622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucgggaggcggcccuggtt

SEQ ID NO: 1623 - RNA, 19 nt, Artificial Sequence
  source: /note="Description of Artificial Sequence: Synthetic oligonucleotide"
ccagggccgccucccgaag

SEQ ID NO: 1624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggccgccucccgaagtt

SEQ ID NO: 1625 - RNA, 19 nt, Artificial Sequence
  source: /note="Description of Artificial Sequence: Synthetic oligonucleotide"
gaccagcucguucgcggag

SEQ ID NO: 1626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccagcucguucgcggagtt

SEQ ID NO: 1627 - RNA, 19 nt, Artificial Sequence
  source: /note="Description of Artificial Sequence: Synthetic oligonucleotide"
cuccgcgaacgagcugguc

SEQ ID NO: 1628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgcgaacgagcugguctt

SEQ ID NO: 1629 - RNA, 19 nt, Artificial Sequence
  source: /note="Description of Artificial Sequence: Synthetic oligonucleotide"
ucccgccgccgggagugaa

SEQ ID NO: 1630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccgccgccgggagugaatt

SEQ ID NO: 1631 - RNA, 19 nt, Artificial Sequence
  source: /note="Description of Artificial Sequence: Synthetic oligonucleotide"
uucacucccggcggcggga

SEQ ID NO: 1632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucacucccggcggcgggatt

SEQ ID NO: 1633 - RNA, 19 nt, Artificial Sequence
  source: /note="Description of Artificial Sequence: Synthetic oligonucleotide"
gccgccgggagugaagcug

SEQ ID NO: 1634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccgggagugaagcugtt

SEQ ID NO: 1635 - RNA, 19 nt, Artificial Sequence
  source: /note="Description of Artificial Sequence: Synthetic oligonucleotide"
cagcuucacucccggcggc

SEQ ID NO: 1636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuucacucccggcggctt

SEQ ID NO: 1637 - RNA, 19 nt, Artificial Sequence
  source: /note="Description of Artificial Sequence: Synthetic oligonucleotide"
ccgccgggagugaagcugg

SEQ ID NO: 1638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgggagugaagcuggtt

SEQ ID NO: 1639 - RNA, 19 nt, Artificial Sequence
  source: /note="Description of Artificial Sequence: Synthetic oligonucleotide"
ccagcuucacucccggcgg

SEQ ID NO: 1640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcuucacucccggcggtt

SEQ ID NO: 1641 - RNA, 19 nt, Artificial Sequence
  source: /note="Description of Artificial Sequence: Synthetic oligonucleotide"
gggccgugacagcgggaag

SEQ ID NO: 1642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccgugacagcgggaagtt

SEQ ID NO: 1643 - RNA, 19 nt, Artificial Sequence
  source: /note="Description of Artificial Sequence: Synthetic oligonucleotide"
cuucccgcugucacggccc

SEQ ID NO: 1644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccgcugucacggccctt

SEQ ID NO: 1645 - RNA, 19 nt, Artificial Sequence
  source: /note="Description of Artificial Sequence: Synthetic oligonucleotide"
guauaccaggcacggcugg

SEQ ID NO: 1646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauaccaggcacggcuggtt

SEQ ID NO: 1647 - RNA, 19 nt, Artificial Sequence
  source: /note="Description of Artificial Sequence: Synthetic oligonucleotide"
ccagccgugccugguauac

SEQ ID NO: 1648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagccgugccugguauactt

SEQ ID NO: 1649 - RNA, 19 nt, Artificial Sequence
  source: /note="Description of Artificial Sequence: Synthetic oligonucleotide"
gagacgagggaacuggugg

SEQ ID NO: 1650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagacgagggaacugguggtt

SEQ ID NO: 1651 - RNA, 19 nt, Artificial Sequence
  source: /note="Description of Artificial Sequence: Synthetic oligonucleotide"
ccaccaguucccucgucuc

SEQ ID NO: 1652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccaguucccucgucuctt

SEQ ID NO: 1653 - RNA, 19 nt, Artificial Sequence
  source: /note="Description of Artificial Sequence: Synthetic oligonucleotide"
gacgagggaacugguggcc

SEQ ID NO: 1654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgagggaacugguggcctt

SEQ ID NO: 1655 - RNA, 19 nt, Artificial Sequence
  source: /note="Description of Artificial Sequence: Synthetic oligonucleotide"
ggccaccaguucccucguc

SEQ ID NO: 1656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaccaguucccucguctt

SEQ ID NO: 1657 - RNA, 19 nt, Artificial Sequence
  source: /note="Description of Artificial Sequence: Synthetic oligonucleotide"
acaaaagguucaagaaccg

SEQ ID NO: 1658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaaagguucaagaaccgtt

SEQ ID NO: 1659 - RNA, 19 nt, Artificial Sequence
  source: /note="Description of Artificial Sequence: Synthetic oligonucleotide"
cgguucuugaaccuuuugu

SEQ ID NO: 1660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguucuugaaccuuuugutt

SEQ ID NO: 1661 - RNA, 19 nt, Artificial Sequence
  source: /note="Description of Artificial Sequence: Synthetic oligonucleotide"
aaagguucaagaaccgaga

SEQ ID NO: 1662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagguucaagaaccgagatt

SEQ ID NO: 1663 - RNA, 19 nt, Artificial Sequence
  source: /note="Description of Artificial Sequence: Synthetic oligonucleotide"
ucucgguucuugaaccuuu

SEQ ID NO: 1664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgguucuugaaccuuutt

SEQ ID NO: 1665 - RNA, 19 nt, Artificial Sequence
  source: /note="Description of Artificial Sequence: Synthetic oligonucleotide"
aagguucaagaaccgagaa

SEQ ID NO: 1666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguucaagaaccgagaatt

SEQ ID NO: 1667 - RNA, 19 nt, Artificial Sequence
  source: /note="Description of Artificial Sequence: Synthetic oligonucleotide"
uucucgguucuugaaccuu

SEQ ID NO: 1668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucgguucuugaaccuutt

SEQ ID NO: 1669 - RNA, 19 nt, Artificial Sequence
  source: /note="Description of Artificial Sequence: Synthetic oligonucleotide"
agaagaaggacgagcugua

SEQ ID NO: 1670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagaaggacgagcuguatt

SEQ ID NO: 1671 - RNA, 19 nt, Artificial Sequence
  source: /note="Description of Artificial Sequence: Synthetic oligonucleotide"
uacagcucguccuucuucu

SEQ ID NO: 1672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagcucguccuucuucutt

SEQ ID NO: 1673 - RNA, 19 nt, Artificial Sequence
  source: /note="Description of Artificial Sequence: Synthetic oligonucleotide"
aagaaggacgagcuguauu

SEQ ID NO: 1674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaggacgagcuguauutt

SEQ ID NO: 1675 - RNA, 19 nt, Artificial Sequence
  source: /note="Description of Artificial Sequence: Synthetic oligonucleotide"
aauacagcucguccuucuu

SEQ ID NO: 1676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauacagcucguccuucuutt

SEQ ID NO: 1677 - RNA, 19 nt, Artificial Sequence
  source: /note="Description of Artificial Sequence: Synthetic oligonucleotide"
agacgguguaccgaguggc

SEQ ID NO: 1678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacgguguaccgaguggctt

SEQ ID NO: 1679 - RNA, 19 nt, Artificial Sequence
  source: /note="Description of Artificial Sequence: Synthetic oligonucleotide"
gccacucgguacaccgucu

SEQ ID NO: 1680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacucgguacaccgucutt

SEQ ID NO: 1681 - RNA, 19 nt, Artificial Sequence
  source: /note="Description of Artificial Sequence: Synthetic oligonucleotide"
ccuaucaucuacaucaagg

SEQ ID NO: 1682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaucaucuacaucaaggtt

SEQ ID NO: 1683 - RNA, 19 nt, Artificial Sequence
  source: /note="Description of Artificial Sequence: Synthetic oligonucleotide"
ccuugauguagaugauagg

SEQ ID NO: 1684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugauguagaugauaggtt

SEQ ID NO: 1685 - RNA, 19 nt, Artificial Sequence
  source: /note="Description of Artificial Sequence: Synthetic oligonucleotide"
agcuuggccuacauccacu

SEQ ID NO: 1686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuggccuacauccacutt

SEQ ID NO: 1687 - RNA, 19 nt, Artificial Sequence
  source: /note="Description of Artificial Sequence: Synthetic oligonucleotide"
aguggauguaggccaagcu

SEQ ID NO: 1688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggauguaggccaagcutt

SEQ ID NO: 1689 - RNA, 19 nt, Artificial Sequence
  source: /note="Description of Artificial Sequence: Synthetic oligonucleotide"
ugucaccgugacaucaagc

SEQ ID NO: 1690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucaccgugacaucaagctt

SEQ ID NO: 1691 - RNA, 19 nt, Artificial Sequence
  source: /note="Description of Artificial Sequence: Synthetic oligonucleotide"
gcuugaugucacggugaca

SEQ ID NO: 1692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugaugucacggugacatt

SEQ ID NO: 1693 - RNA, 19 nt, Artificial Sequence
  source: /note="Description of Artificial Sequence: Synthetic oligonucleotide"
ggacccugacacugcuguc

SEQ ID NO: 1694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacccugacacugcuguctt

SEQ ID NO: 1695 - RNA, 19 nt, Artificial Sequence
  source: /note="Description of Artificial Sequence: Synthetic oligonucleotide"
gacagcagugucagggucc

SEQ ID NO: 1696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacagcagugucagggucctt

SEQ ID NO: 1697 - RNA, 19 nt, Artificial Sequence
  source: /note="Description of Artificial Sequence: Synthetic oligonucleotide"
gggagcccaauguguccua

SEQ ID NO: 1698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagcccaauguguccuatt

SEQ ID NO: 1699 - RNA, 19 nt, Artificial Sequence
  source: /note="Description of Artificial Sequence: Synthetic oligonucleotide"
uaggacacauugggcuccc

SEQ ID NO: 1700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggacacauugggcuccctt

SEQ ID NO: 1701 - RNA, 19 nt, Artificial Sequence
  source: /note="Description of Artificial Sequence: Synthetic oligonucleotide"
aauguguccuacaucugcu

SEQ ID NO: 1702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauguguccuacaucugcutt

SEQ ID NO: 1703 - RNA, 19 nt, Artificial Sequence
  source: /note="Description of Artificial Sequence: Synthetic oligonucleotide"
agcagauguaggacacauu

SEQ ID NO: 1704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagauguaggacacauutt

SEQ ID NO: 1705 - RNA, 19 nt, Artificial Sequence
  source: /note="Description of Artificial Sequence: Synthetic oligonucleotide"
uguguacuugcugagcuac

SEQ ID NO: 1706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguacuugcugagcuactt

SEQ ID NO: 1707 - RNA, 19 nt, Artificial Sequence
  source: /note="Description of Artificial Sequence: Synthetic oligonucleotide"
guagcucagcaaguacaca

SEQ ID NO: 1708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagcucagcaaguacacatt

SEQ ID NO: 1709 - RNA, 19 nt, Artificial Sequence
  source: /note="Description of Artificial Sequence: Synthetic oligonucleotide"
ugcugagcuacuucucggc

SEQ ID NO: 1710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcugagcuacuucucggctt

SEQ ID NO: 1711 - RNA, 19 nt, Artificial Sequence
  source: /note="Description of Artificial Sequence: Synthetic oligonucleotide"
gccgagaaguagcucagca

SEQ ID NO: 1712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgagaaguagcucagcatt

SEQ ID NO: 1713 - RNA, 19 nt, Artificial Sequence
  source: /note="Description of Artificial Sequence: Synthetic oligonucleotide"
caaagcucacccuuggaca

SEQ ID NO: 1714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagcucacccuuggacatt

SEQ ID NO: 1715 - RNA, 19 nt, Artificial Sequence
  source: /note="Description of Artificial Sequence: Synthetic oligonucleotide"
uguccaagggugagcuuug

SEQ ID NO: 1716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccaagggugagcuuugtt

SEQ ID NO: 1717 - RNA, 19 nt, Artificial Sequence
  source: /note="Description of Artificial Sequence: Synthetic oligonucleotide"
guguucaaaucuucaaaga

SEQ ID NO: 1718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguucaaaucuucaaagatt

SEQ ID NO: 1719 - RNA, 19 nt, Artificial Sequence
  source: /note="Description of Artificial Sequence: Synthetic oligonucleotide"
ucuuugaagauuugaacac

SEQ ID NO: 1720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuugaagauuugaacactt

SEQ ID NO: 1721 - RNA, 19 nt, Artificial Sequence
  source: /note="Description of Artificial Sequence: Synthetic oligonucleotide"
acaccaccugaggccauug

SEQ ID NO: 1722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccaccugaggccauugtt

SEQ ID NO: 1723 - RNA, 19 nt, Artificial Sequence
  source: /note="Description of Artificial Sequence: Synthetic oligonucleotide"
caauggccucagguggugu

SEQ ID NO: 1724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauggccucagguggugutt

SEQ ID NO: 1725 - RNA, 19 nt, Artificial Sequence
  source: /note="Description of Artificial Sequence: Synthetic oligonucleotide"
caccugaggccauugcacu

SEQ ID NO: 1726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccugaggccauugcacutt

SEQ ID NO: 1727 - RNA, 19 nt, Artificial Sequence
  source: /note="Description of Artificial Sequence: Synthetic oligonucleotide"
agugcaauggccucaggug

SEQ ID NO: 1728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcaauggccucaggugtt

SEQ ID NO: 1729 - RNA, 19 nt, Artificial Sequence
  source: /note="Description of Artificial Sequence: Synthetic oligonucleotide"
gcacucugcucuagccuac

SEQ ID NO: 1730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacucugcucuagccuactt

SEQ ID NO: 1731 - RNA, 19 nt, Artificial Sequence
  source: /note="Description of Artificial Sequence: Synthetic oligonucleotide"
guaggcuagagcagagugc

SEQ ID NO: 1732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggcuagagcagagugctt

SEQ ID NO: 1733 - RNA, 19 nt, Artificial Sequence
  source: /note="Description of Artificial Sequence: Synthetic oligonucleotide"
ugcucuagccuacuggagu

SEQ ID NO: 1734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcucuagccuacuggagutt

SEQ ID NO: 1735 - RNA, 19 nt, Artificial Sequence
  source: /note="Description of Artificial Sequence: Synthetic oligonucleotide"
acuccaguaggcuagagca

SEQ ID NO: 1736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccaguaggcuagagcatt

SEQ ID NO: 1737 - RNA, 19 nt, Artificial Sequence
  source: /note="Description of Artificial Sequence: Synthetic oligonucleotide"
ugaacugcggagacucgga

SEQ ID NO: 1738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacugcggagacucggatt

SEQ ID NO: 1739 - RNA, 19 nt, Artificial Sequence
  source: /note="Description of Artificial Sequence: Synthetic oligonucleotide"
uccgagucuccgcaguuca

SEQ ID NO: 1740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgagucuccgcaguucatt

SEQ ID NO: 1741 - RNA, 19 nt, Artificial Sequence
  source: /note="Description of Artificial Sequence: Synthetic oligonucleotide"
gaacugcggagacucggag

SEQ ID NO: 1742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacugcggagacucggagtt

SEQ ID NO: 1743 - RNA, 19 nt, Artificial Sequence
  source: /note="Description of Artificial Sequence: Synthetic oligonucleotide"
cuccgagucuccgcaguuc

SEQ ID NO: 1744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgagucuccgcaguuctt

SEQ ID NO: 1745 - RNA, 19 nt, Artificial Sequence
  source: /note="Description of Artificial Sequence: Synthetic oligonucleotide"
gagacucggagcccagcuc

SEQ ID NO: 1746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagacucggagcccagcuctt

SEQ ID NO: 1747 - RNA, 19 nt, Artificial Sequence
  source: /note="Description of Artificial Sequence: Synthetic oligonucleotide"
gagcugggcuccgagucuc

SEQ ID NO: 1748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcugggcuccgagucuctt

SEQ ID NO: 1749 - RNA, 19 nt, Artificial Sequence
  source: /note="Description of Artificial Sequence: Synthetic oligonucleotide"
aacuucaguccuggugaac

SEQ ID NO: 1750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuucaguccuggugaactt

SEQ ID NO: 1751 - RNA, 19 nt, Artificial Sequence
  source: /note="Description of Artificial Sequence: Synthetic oligonucleotide"
guucaccaggacugaaguu

SEQ ID NO: 1752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaccaggacugaaguutt

SEQ ID NO: 1753 - RNA, 19 nt, Artificial Sequence
  source: /note="Description of Artificial Sequence: Synthetic oligonucleotide"
acuucaguccuggugaacu

SEQ ID NO: 1754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucaguccuggugaacutt

SEQ ID NO: 1755 - RNA, 19 nt, Artificial Sequence
  source: /note="Description of Artificial Sequence: Synthetic oligonucleotide"
aguucaccaggacugaagu

SEQ ID NO: 1756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucaccaggacugaagutt

SEQ ID NO: 1757 - RNA, 19 nt, Artificial Sequence
  source: /note="Description of Artificial Sequence: Synthetic oligonucleotide"
gaacuguccauccaaccau

SEQ ID NO: 1758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuguccauccaaccautt

SEQ ID NO: 1759 - RNA, 19 nt, Artificial Sequence
  source: /note="Description of Artificial Sequence: Synthetic oligonucleotide"
augguuggauggacaguuc

SEQ ID NO: 1760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augguuggauggacaguuctt

SEQ ID NO: 1761 - RNA, 19 nt, Artificial Sequence
  source: /note="Description of Artificial Sequence: Synthetic oligonucleotide"
uccuacaacccauccucac

SEQ ID NO: 1762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuacaacccauccucactt

SEQ ID NO: 1763 - RNA, 19 nt, Artificial Sequence
  source: /note="Description of Artificial Sequence: Synthetic oligonucleotide"
gugaggauggguuguagga

SEQ ID NO: 1764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaggauggguuguaggatt

SEQ ID NO: 1765 - RNA, 19 nt, Artificial Sequence
  source: /note="Description of Artificial Sequence: Synthetic oligonucleotide"
caacccauccucacaagcu

SEQ ID NO: 1766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacccauccucacaagcutt

SEQ ID NO: 1767 - RNA, 19 nt, Artificial Sequence
  source: /note="Description of Artificial Sequence: Synthetic oligonucleotide"
agcuugugaggauggguug

SEQ ID NO: 1768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuugugaggauggguugtt

SEQ ID NO: 1769 - RNA, 19 nt, Artificial Sequence
  source: /note="Description of Artificial Sequence: Synthetic oligonucleotide"
caagcuuuaacugaagcuc

SEQ ID NO: 1770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcuuuaacugaagcuctt

SEQ ID NO: 1771 - RNA, 19 nt, Artificial Sequence
  source: /note="Description of Artificial Sequence: Synthetic oligonucleotide"
gagcuucaguuaaagcuug

SEQ ID NO: 1772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuucaguuaaagcuugtt

SEQ ID NO: 1773 - RNA, 19 nt, Artificial Sequence
  source: /note="Description of Artificial Sequence: Synthetic oligonucleotide"
cuaggccucccucagcagc

SEQ ID NO: 1774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggccucccucagcagctt

SEQ ID NO: 1775 - RNA, 19 nt, Artificial Sequence
  source: /note="Description of Artificial Sequence: Synthetic oligonucleotide"
gcugcugagggaggccuag

SEQ ID NO: 1776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcugagggaggccuagtt

SEQ ID NO: 1777 - RNA, 19 nt, Artificial Sequence
  source: /note="Description of Artificial Sequence: Synthetic oligonucleotide"
ccccaggcuaccacuccuu

SEQ ID NO: 1778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccaggcuaccacuccuutt

SEQ ID NO: 1779 - RNA, 19 nt, Artificial Sequence
  source: /note="Description of Artificial Sequence: Synthetic oligonucleotide"
aaggagugguagccugggg

SEQ ID NO: 1780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggagugguagccuggggtt

SEQ ID NO: 1781 - RNA, 19 nt, Artificial Sequence
  source: /note="Description of Artificial Sequence: Synthetic oligonucleotide"
aauagaaccagcccagccc

SEQ ID NO: 1782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauagaaccagcccagccctt

SEQ ID NO: 1783 - RNA, 19 nt, Artificial Sequence
  source: /note="Description of Artificial Sequence: Synthetic oligonucleotide"
gggcugggcugguucuauu

SEQ ID NO: 1784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcugggcugguucuauutt

SEQ ID NO: 1785 - RNA, 19 nt, Artificial Sequence
  source: /note="Description of Artificial Sequence: Synthetic oligonucleotide"
auagaaccagcccagccca

SEQ ID NO: 1786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagaaccagcccagcccatt

SEQ ID NO: 1787 - RNA, 19 nt, Artificial Sequence
  source: /note="Description of Artificial Sequence: Synthetic oligonucleotide"
ugggcugggcugguucuau

SEQ ID NO: 1788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcugggcugguucuautt

SEQ ID NO: 1789 - RNA, 19 nt, Artificial Sequence
  source: /note="Description of Artificial Sequence: Synthetic oligonucleotide"
cuggguguaaauagauugu

SEQ ID NO: 1790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggguguaaauagauugutt

SEQ ID NO: 1791 - RNA, 19 nt, Artificial Sequence
  source: /note="Description of Artificial Sequence: Synthetic oligonucleotide"
acaaucuauuuacacccag

SEQ ID NO: 1792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaucuauuuacacccagtt

SEQ ID NO: 1793 - RNA, 19 nt, Artificial Sequence
  source: /note="Description of Artificial Sequence: Synthetic oligonucleotide"
ccauucaacuugccccccc

SEQ ID NO: 1794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauucaacuugccccccctt

SEQ ID NO: 1795 - RNA, 19 nt, Artificial Sequence
  source: /note="Description of Artificial Sequence: Synthetic oligonucleotide"
gggggggcaaguugaaugg

SEQ ID NO: 1796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggggcaaguugaauggtt

SEQ ID NO: 1797 - RNA, 19 nt, Artificial Sequence
  source: /note="Description of Artificial Sequence: Synthetic oligonucleotide"
caacuugccccccccagcu

SEQ ID NO: 1798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacuugccccccccagcutt

SEQ ID NO: 1799 - RNA, 19 nt, Artificial Sequence
  source: /note="Description of Artificial Sequence: Synthetic oligonucleotide"
agcuggggggggcaaguug

SEQ ID NO: 1800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuggggggggcaaguugtt

SEQ ID NO: 1801 - RNA, 19 nt, Artificial Sequence
  source: /note="Description of Artificial Sequence: Synthetic oligonucleotide"
uugccccccccagcuguac

SEQ ID NO: 1802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugccccccccagcuguactt

SEQ ID NO: 1803 - RNA, 19 nt, Artificial Sequence
  source: /note="Description of Artificial Sequence: Synthetic oligonucleotide"
guacagcuggggggggcaa

SEQ ID NO: 1804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacagcuggggggggcaatt

SEQ ID NO: 1805 - RNA, 19 nt, Artificial Sequence
  source: /note="Description of Artificial Sequence: Synthetic oligonucleotide"
ccccagcuguaccccuucu

SEQ ID NO: 1806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagcuguaccccuucutt

SEQ ID NO: 1807 - RNA, 19 nt, Artificial Sequence
  source: /note="Description of Artificial Sequence: Synthetic oligonucleotide"
agaagggguacagcugggg

SEQ ID NO: 1808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagggguacagcuggggtt

SEQ ID NO: 1809 - RNA, 19 nt, Artificial Sequence
  source: /note="Description of Artificial Sequence: Synthetic oligonucleotide"
cagcuguaccccuucuugu

SEQ ID NO: 1810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuguaccccuucuugutt

SEQ ID NO: 1811 - RNA, 19 nt, Artificial Sequence
  source: /note="Description of Artificial Sequence: Synthetic oligonucleotide"
acaagaagggguacagcug

SEQ ID NO: 1812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagaagggguacagcugtt

SEQ ID NO: 1813 - RNA, 19 nt, Artificial Sequence
  source: /note="Description of Artificial Sequence: Synthetic oligonucleotide"
agcuguaccccuucuuguc

SEQ ID NO: 1814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuguaccccuucuuguctt

SEQ ID NO: 1815 - RNA, 19 nt, Artificial Sequence
  source: /note="Description of Artificial Sequence: Synthetic oligonucleotide"
gacaagaagggguacagcu

SEQ ID NO: 1816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaagaagggguacagcutt

SEQ ID NO: 1817 - RNA, 19 nt, Artificial Sequence
  source: /note="Description of Artificial Sequence: Synthetic oligonucleotide"
uccuggaaggaggggagua

SEQ ID NO: 1818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuggaaggaggggaguatt

SEQ ID NO: 1819 - RNA, 19 nt, Artificial Sequence
  source: /note="Description of Artificial Sequence: Synthetic oligonucleotide"
uacuccccuccuuccagga

SEQ ID NO: 1820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccccuccuuccaggatt

SEQ ID NO: 1821 - RNA, 19 nt, Artificial Sequence
  source: /note="Description of Artificial Sequence: Synthetic oligonucleotide"
gggaguagagagagucccu

SEQ ID NO: 1822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaguagagagagucccutt

SEQ ID NO: 1823 - RNA, 19 nt, Artificial Sequence
  source: /note="Description of Artificial Sequence: Synthetic oligonucleotide"
agggacucucucuacuccc

SEQ ID NO: 1824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggacucucucuacuccctt

SEQ ID NO: 1825 - RNA, 19 nt, Artificial Sequence
  source: /note="Description of Artificial Sequence: Synthetic oligonucleotide"
gagagagucccuggugucu

SEQ ID NO: 1826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagagucccuggugucutt

SEQ ID NO: 1827 - RNA, 19 nt, Artificial Sequence
  source: /note="Description of Artificial Sequence: Synthetic oligonucleotide"
agacaccagggacucucuc

SEQ ID NO: 1828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacaccagggacucucuctt

SEQ ID NO: 1829 - RNA, 19 nt, Artificial Sequence
  source: /note="Description of Artificial Sequence: Synthetic oligonucleotide"
uguguacagaccucuguuc

SEQ ID NO: 1830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguacagaccucuguuctt

SEQ ID NO: 1831 - RNA, 19 nt, Artificial Sequence
  source: /note="Description of Artificial Sequence: Synthetic oligonucleotide"
gaacagaggucuguacaca

SEQ ID NO: 1832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacagaggucuguacacatt

SEQ ID NO: 1833 - RNA, 19 nt, Artificial Sequence
  source: /note="Description of Artificial Sequence: Synthetic oligonucleotide"
guguacagaccucuguuca

SEQ ID NO: 1834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacagaccucuguucatt

SEQ ID NO: 1835 - RNA, 19 nt, Artificial Sequence
  source: /note="Description of Artificial Sequence: Synthetic oligonucleotide"
ugaacagaggucuguacac

SEQ ID NO: 1836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacagaggucuguacactt

SEQ ID NO: 1837 - RNA, 19 nt, Artificial Sequence
  source: /note="Description of Artificial Sequence: Synthetic oligonucleotide"
auaaauuauuggcaugaaa

SEQ ID NO: 1838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaaauuauuggcaugaaatt

SEQ ID NO: 1839 - RNA, 19 nt, Artificial Sequence
  source: /note="Description of Artificial Sequence: Synthetic oligonucleotide"
uuucaugccaauaauuuau

SEQ ID NO: 1840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucaugccaauaauuuautt

SEQ ID NO: 1841 - RNA, 19 nt, Artificial Sequence
  source: /note="Description of Artificial Sequence: Synthetic oligonucleotide"
uaaauuauuggcaugaaac

SEQ ID NO: 1842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaauuauuggcaugaaactt

SEQ ID NO: 1843 - RNA, 19 nt, Artificial Sequence
  source: /note="Description of Artificial Sequence: Synthetic oligonucleotide"
guuucaugccaauaauuua

SEQ ID NO: 1844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuucaugccaauaauuuatt

SEQ ID NO: 1845 - RNA, 19 nt, Artificial Sequence
  source: /note="Description of Artificial Sequence: Synthetic oligonucleotide"
uggcaugaaacccuuaaaa

SEQ ID NO: 1846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcaugaaacccuuaaaatt

SEQ ID NO: 1847 - RNA, 19 nt, Artificial Sequence
  source: /note="Description of Artificial Sequence: Synthetic oligonucleotide"
uuuuaaggguuucaugcca

SEQ ID NO: 1848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuaaggguuucaugccatt

SEQ ID NO: 1849 - RNA, 19 nt, Artificial Sequence
  source: /note="Description of Artificial Sequence: Synthetic oligonucleotide"
aagccgacggcagagggac

SEQ ID NO: 1850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccgacggcagagggactt

SEQ ID NO: 1851 - RNA, 19 nt, Artificial Sequence
  source: /note="Description of Artificial Sequence: Synthetic oligonucleotide"
gucccucugccgucggcuu

SEQ ID NO: 1852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucccucugccgucggcuutt

SEQ ID NO: 1853 - RNA, 19 nt, Artificial Sequence
  source: /note="Description of Artificial Sequence: Synthetic oligonucleotide"
ggcagagggacuucaucuc

SEQ ID NO: 1854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagagggacuucaucuctt

SEQ ID NO: 1855 - RNA, 19 nt, Artificial Sequence
  source: /note="Description of Artificial Sequence: Synthetic oligonucleotide"
gagaugaagucccucugcc

SEQ ID NO: 1856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaugaagucccucugcctt

SEQ ID NO: 1857 - RNA, 19 nt, Artificial Sequence
  source: /note="Description of Artificial Sequence: Synthetic oligonucleotide"
gcagagggacuucaucucc

SEQ ID NO: 1858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagggacuucaucucctt

SEQ ID NO: 1859 - RNA, 19 nt, Artificial Sequence
  source: /note="Description of Artificial Sequence: Synthetic oligonucleotide"
ggagaugaagucccucugc

SEQ ID NO: 1860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaugaagucccucugctt

SEQ ID NO: 1861 - RNA, 19 nt, Artificial Sequence
  source: /note="Description of Artificial Sequence: Synthetic oligonucleotide"
cagagggacuucaucuccc

SEQ ID NO: 1862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagggacuucaucuccctt

SEQ ID NO: 1863 - RNA, 19 nt, Artificial Sequence
  source: /note="Description of Artificial Sequence: Synthetic oligonucleotide"
gggagaugaagucccucug

SEQ ID NO: 1864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagaugaagucccucugtt

SEQ ID NO: 1865 - RNA, 19 nt, Artificial Sequence
  source: /note="Description of Artificial Sequence: Synthetic oligonucleotide"
gagggacuucaucucccgg

SEQ ID NO: 1866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggacuucaucucccggtt

SEQ ID NO: 1867 - RNA, 19 nt, Artificial Sequence
  source: /note="Description of Artificial Sequence: Synthetic oligonucleotide"
ccgggagaugaagucccuc

SEQ ID NO: 1868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgggagaugaagucccuctt

SEQ ID NO: 1869 - RNA, 19 nt, Artificial Sequence
  source: /note="Description of Artificial Sequence: Synthetic oligonucleotide"
acuucaucucccggcgugc

SEQ ID NO: 1870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucaucucccggcgugctt

SEQ ID NO: 1871 - RNA, 19 nt, Artificial Sequence
  source: /note="Description of Artificial Sequence: Synthetic oligonucleotide"
gcacgccgggagaugaagu

SEQ ID NO: 1872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacgccgggagaugaagutt

SEQ ID NO: 1873 - RNA, 19 nt, Artificial Sequence
  source: /note="Description of Artificial Sequence: Synthetic oligonucleotide"
cuucaucucccggcgugcc

SEQ ID NO: 1874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaucucccggcgugcctt

SEQ ID NO: 1875 - RNA, 19 nt, Artificial Sequence
  source: /note="Description of Artificial Sequence: Synthetic oligonucleotide"
ggcacgccgggagaugaag

SEQ ID NO: 1876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacgccgggagaugaagtt

SEQ ID NO: 1877 - RNA, 19 nt, Artificial Sequence
  source: /note="Description of Artificial Sequence: Synthetic oligonucleotide"
uucaucucccggcgugccc

SEQ ID NO: 1878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaucucccggcgugccctt

SEQ ID NO: 1879 - RNA, 19 nt, Artificial Sequence
  source: /note="Description of Artificial Sequence: Synthetic oligonucleotide"
gggcacgccgggagaugaa

SEQ ID NO: 1880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcacgccgggagaugaatt

SEQ ID NO: 1881 - RNA, 19 nt, Artificial Sequence
  source: /note="Description of Artificial Sequence: Synthetic oligonucleotide"
ucucccggcgugccccgcg

SEQ ID NO: 1882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucccggcgugccccgcgtt

SEQ ID NO: 1883 - RNA, 19 nt, Artificial Sequence
  source: /note="Description of Artificial Sequence: Synthetic oligonucleotide"
cgcggggcacgccgggaga

SEQ ID NO: 1884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggggcacgccgggagatt

SEQ ID NO: 1885 - RNA, 19 nt, Artificial Sequence
  source: /note="Description of Artificial Sequence: Synthetic oligonucleotide"
cggcgugccccgcggcggg

SEQ ID NO: 1886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgugccccgcggcgggtt

SEQ ID NO: 1887 - RNA, 19 nt, Artificial Sequence
  source: /note="Description of Artificial Sequence: Synthetic oligonucleotide"
cccgccgcggggcacgccg

SEQ ID NO: 1888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccgcggggcacgccgtt

SEQ ID NO: 1889 - RNA, 19 nt, Artificial Sequence
  source: /note="Description of Artificial Sequence: Synthetic oligonucleotide"
cgugccccgcggcgggcgc

SEQ ID NO: 1890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugccccgcggcgggcgctt

SEQ ID NO: 1891 - RNA, 19 nt, Artificial Sequence
  source: /note="Description of Artificial Sequence: Synthetic oligonucleotide"
gcgcccgccgcggggcacg

SEQ ID NO: 1892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcccgccgcggggcacgtt

SEQ ID NO: 1893 - RNA, 19 nt, Artificial Sequence
  source: /note="Description of Artificial Sequence: Synthetic oligonucleotide"
gugccccgcggcgggcgcu

SEQ ID NO: 1894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugccccgcggcgggcgcutt

SEQ ID NO: 1895 - RNA, 19 nt, Artificial Sequence
  source: /note="Description of Artificial Sequence: Synthetic oligonucleotide"
agcgcccgccgcggggcac

SEQ ID NO: 1896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgcccgccgcggggcactt

SEQ ID NO: 1897 - RNA, 19 nt, Artificial Sequence
  source: /note="Description of Artificial Sequence: Synthetic oligonucleotide"
gcggcgggcgcugggccgg

SEQ ID NO: 1898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcgggcgcugggccggtt

SEQ ID NO: 1899 - RNA, 19 nt, Artificial Sequence
  source: /note="Description of Artificial Sequence: Synthetic oligonucleotide"
ccggcccagcgcccgccgc

SEQ ID NO: 1900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcccagcgcccgccgctt

SEQ ID NO: 1901 - RNA, 19 nt, Artificial Sequence
  source: /note="Description of Artificial Sequence: Synthetic oligonucleotide"
ggcgcugggccggagccgg

SEQ ID NO: 1902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcugggccggagccggtt

SEQ ID NO: 1903 - RNA, 19 nt, Artificial Sequence
  source: /note="Description of Artificial Sequence: Synthetic oligonucleotide"
ccggcuccggcccagcgcc

SEQ ID NO: 1904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcuccggcccagcgcctt

SEQ ID NO: 1905 - RNA, 19 nt, Artificial Sequence
  source: /note="Description of Artificial Sequence: Synthetic oligonucleotide"
acggcgcggccuggaagag

SEQ ID NO: 1906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggcgcggccuggaagagtt

SEQ ID NO: 1907 - RNA, 19 nt, Artificial Sequence
  source: /note="Description of Artificial Sequence: Synthetic oligonucleotide"
cucuuccaggccgcgccgu

SEQ ID NO: 1908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuuccaggccgcgccgutt

SEQ ID NO: 1909 - RNA, 19 nt, Artificial Sequence
  source: /note="Description of Artificial Sequence: Synthetic oligonucleotide"
cgcggccuggaagaggccg

SEQ ID NO: 1910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggccuggaagaggccgtt

SEQ ID NO: 1911 - RNA, 19 nt, Artificial Sequence
  source: /note="Description of Artificial Sequence: Synthetic oligonucleotide"
cggccucuuccaggccgcg

SEQ ID NO: 1912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccucuuccaggccgcgtt

SEQ ID NO: 1913 - RNA, 19 nt, Artificial Sequence
  source: /note="Description of Artificial Sequence: Synthetic oligonucleotide"
cuggaagaggccggagccc

SEQ ID NO: 1914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaagaggccggagccctt

SEQ ID NO: 1915 - RNA, 19 nt, Artificial Sequence
  source: /note="Description of Artificial Sequence: Synthetic oligonucleotide"
gggcuccggccucuuccag

SEQ ID NO: 1916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuccggccucuuccagtt

SEQ ID NO: 1917 - RNA, 19 nt, Artificial Sequence
  source: /note="Description of Artificial Sequence: Synthetic oligonucleotide"
aagaggccggagcccaggg

SEQ ID NO: 1918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaggccggagcccagggtt

SEQ ID NO: 1919 - RNA, 19 nt, Artificial Sequence
  source: /note="Description of Artificial Sequence: Synthetic oligonucleotide"
cccugggcuccggccucuu

SEQ ID NO: 1920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugggcuccggccucuutt

SEQ ID NO: 1921 - RNA, 19 nt, Artificial Sequence
  source: /note="Description of Artificial Sequence: Synthetic oligonucleotide"
gaggccggagcccagggga

SEQ ID NO: 1922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggccggagcccaggggatt

SEQ ID NO: 1923 - RNA, 19 nt, Artificial Sequence
  source: /note="Description of Artificial Sequence: Synthetic oligonucleotide"
uccccugggcuccggccuc

SEQ ID NO: 1924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccugggcuccggccuctt

SEQ ID NO: 1925 - RNA, 19 nt, Artificial Sequence
  source: /note="Description of Artificial Sequence: Synthetic oligonucleotide"
gcagcccaggcagcccgag

SEQ ID NO: 1926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcccaggcagcccgagtt

SEQ ID NO: 1927 - RNA, 19 nt, Artificial Sequence
  source: /note="Description of Artificial Sequence: Synthetic oligonucleotide"
cucgggcugccugggcugc

SEQ ID NO: 1928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgggcugccugggcugctt

SEQ ID NO: 1929 - RNA, 19 nt, Artificial Sequence
  source: /note="Description of Artificial Sequence: Synthetic oligonucleotide"
cagcccaggcagcccgagc

SEQ ID NO: 1930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccaggcagcccgagctt

SEQ ID NO: 1931 - RNA, 19 nt, Artificial Sequence
  source: /note="Description of Artificial Sequence: Synthetic oligonucleotide"
gcucgggcugccugggcug

SEQ ID NO: 1932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucgggcugccugggcugtt

SEQ ID NO: 1933 - RNA, 19 nt, Artificial Sequence
  source: /note="Description of Artificial Sequence: Synthetic oligonucleotide"
cccaggcagcccgagcccc

SEQ ID NO: 1934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggcagcccgagcccctt

SEQ ID NO: 1935 - RNA, 19 nt, Artificial Sequence
  source: /note="Description of Artificial Sequence: Synthetic oligonucleotide"
ggggcucgggcugccuggg

SEQ ID NO: 1936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcucgggcugccugggtt

SEQ ID NO: 1937 - RNA, 19 nt, Artificial Sequence
  source: /note="Description of Artificial Sequence: Synthetic oligonucleotide"
ccaggcagcccgagccccg

SEQ ID NO: 1938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggcagcccgagccccgtt

SEQ ID NO: 1939 - RNA, 19 nt, Artificial Sequence
  source: /note="Description of Artificial Sequence: Synthetic oligonucleotide"
cggggcucgggcugccugg

SEQ ID NO: 1940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggcucgggcugccuggtt

SEQ ID NO: 1941 - RNA, 19 nt, Artificial Sequence
  source: /note="Description of Artificial Sequence: Synthetic oligonucleotide"
cccgagccccgcggccugg

SEQ ID NO: 1942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgagccccgcggccuggtt

SEQ ID NO: 1943 - RNA, 19 nt, Artificial Sequence
  source: /note="Description of Artificial Sequence: Synthetic oligonucleotide"
ccaggccgcggggcucggg

SEQ ID NO: 1944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggccgcggggcucgggtt

SEQ ID NO: 1945 - RNA, 19 nt, Artificial Sequence
  source: /note="Description of Artificial Sequence: Synthetic oligonucleotide"
cggccugggccugcgcucg

SEQ ID NO: 1946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccugggccugcgcucgtt

SEQ ID NO: 1947 - RNA, 19 nt, Artificial Sequence
  source: /note="Description of Artificial Sequence: Synthetic oligonucleotide"
cgagcgcaggcccaggccg

SEQ ID NO: 1948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcgcaggcccaggccgtt

SEQ ID NO: 1949 - RNA, 19 nt, Artificial Sequence
  source: /note="Description of Artificial Sequence: Synthetic oligonucleotide"
ggccugggccugcgcucgg

SEQ ID NO: 1950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccugggccugcgcucggtt

SEQ ID NO: 1951 - RNA, 19 nt, Artificial Sequence
  source: /note="Description of Artificial Sequence: Synthetic oligonucleotide"
ccgagcgcaggcccaggcc

SEQ ID NO: 1952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagcgcaggcccaggcctt

SEQ ID NO: 1953 - RNA, 19 nt, Artificial Sequence
  source: /note="Description of Artificial Sequence: Synthetic oligonucleotide"
ggccugcgcucggcgccau

SEQ ID NO: 1954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccugcgcucggcgccautt

SEQ ID NO: 1955 - RNA, 19 nt, Artificial Sequence
  source: /note="Description of Artificial Sequence: Synthetic oligonucleotide"
auggcgccgagcgcaggcc

SEQ ID NO: 1956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcgccgagcgcaggcctt

SEQ ID NO: 1957 - RNA, 19 nt, Artificial Sequence
  source: /note="Description of Artificial Sequence: Synthetic oligonucleotide"
ugcgcucggcgccaugagc

SEQ ID NO: 1958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcgcucggcgccaugagctt

SEQ ID NO: 1959 - RNA, 19 nt, Artificial Sequence
  source: /note="Description of Artificial Sequence: Synthetic oligonucleotide"
gcucauggcgccgagcgca

SEQ ID NO: 1960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucauggcgccgagcgcatt

SEQ ID NO: 1961 - RNA, 19 nt, Artificial Sequence
  source: /note="Description of Artificial Sequence: Synthetic oligonucleotide"
augagcggcggcgggccuu

SEQ ID NO: 1962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augagcggcggcgggccuutt

SEQ ID NO: 1963 - RNA, 19 nt, Artificial Sequence
  source: /note="Description of Artificial Sequence: Synthetic oligonucleotide"
aaggcccgccgccgcucau

SEQ ID NO: 1964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcccgccgccgcucautt

SEQ ID NO: 1965 - RNA, 19 nt, Artificial Sequence
  source: /note="Description of Artificial Sequence: Synthetic oligonucleotide"
ugagcggcggcgggccuuc

SEQ ID NO: 1966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagcggcggcgggccuuctt

SEQ ID NO: 1967 - RNA, 19 nt, Artificial Sequence
  source: /note="Description of Artificial Sequence: Synthetic oligonucleotide"
gaaggcccgccgccgcuca

SEQ ID NO: 1968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggcccgccgccgcucatt

SEQ ID NO: 1969 - RNA, 19 nt, Artificial Sequence
  source: /note="Description of Artificial Sequence: Synthetic oligonucleotide"
gagcggcggcgggccuucg

SEQ ID NO: 1970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcggcggcgggccuucgtt

SEQ ID NO: 1971 - RNA, 19 nt, Artificial Sequence
  source: /note="Description of Artificial Sequence: Synthetic oligonucleotide"
cgaaggcccgccgccgcuc

SEQ ID NO: 1972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaaggcccgccgccgcuctt

SEQ ID NO: 1973 - RNA, 19 nt, Artificial Sequence
  source: /note="Description of Artificial Sequence: Synthetic oligonucleotide"
agcggcggcgggccuucgg

SEQ ID NO: 1974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcggcggcgggccuucggtt

SEQ ID NO: 1975 - RNA, 19 nt, Artificial Sequence
  source: /note="Description of Artificial Sequence: Synthetic oligonucleotide"
ccgaaggcccgccgccgcu

SEQ ID NO: 1976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaaggcccgccgccgcutt

SEQ ID NO: 1977 - RNA, 19 nt, Artificial Sequence
  source: /note="Description of Artificial Sequence: Synthetic oligonucleotide"
cggcggcgggccuucggga

SEQ ID NO: 1978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcggcgggccuucgggatt

SEQ ID NO: 1979 - RNA, 19 nt, Artificial Sequence
  source: /note="Description of Artificial Sequence: Synthetic oligonucleotide"
ucccgaaggcccgccgccg

SEQ ID NO: 1980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccgaaggcccgccgccgtt

SEQ ID NO: 1981 - RNA, 19 nt, Artificial Sequence
  source: /note="Description of Artificial Sequence: Synthetic oligonucleotide"
cggcgggccuucgggaggc

SEQ ID NO: 1982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgggccuucgggaggctt

SEQ ID NO: 1983 - RNA, 19 nt, Artificial Sequence
  source: /note="Description of Artificial Sequence: Synthetic oligonucleotide"
gccucccgaaggcccgccg

SEQ ID NO: 1984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucccgaaggcccgccgtt

SEQ ID NO: 1985 - RNA, 19 nt, Artificial Sequence
  source: /note="Description of Artificial Sequence: Synthetic oligonucleotide"
accagcucguucgcggagc

SEQ ID NO: 1986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcucguucgcggagctt

SEQ ID NO: 1987 - RNA, 19 nt, Artificial Sequence
  source: /note="Description of Artificial Sequence: Synthetic oligonucleotide"
gcuccgcgaacgagcuggu

SEQ ID NO: 1988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccgcgaacgagcuggutt

SEQ ID NO: 1989 - RNA, 19 nt, Artificial Sequence
  source: /note="Description of Artificial Sequence: Synthetic oligonucleotide"
cguucgcggagccaggagg

SEQ ID NO: 1990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguucgcggagccaggaggtt

SEQ ID NO: 1991 - RNA, 19 nt, Artificial Sequence
  source: /note="Description of Artificial Sequence: Synthetic oligonucleotide"
ccuccuggcuccgcgaacg

SEQ ID NO: 1992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccuggcuccgcgaacgtt

SEQ ID NO: 1993 - RNA, 19 nt, Artificial Sequence
  source: /note="Description of Artificial Sequence: Synthetic oligonucleotide"
cgcggagccaggaggcgga

SEQ ID NO: 1994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggagccaggaggcggatt

SEQ ID NO: 1995 - RNA, 19 nt, Artificial Sequence
  source: /note="Description of Artificial Sequence: Synthetic oligonucleotide"
uccgccuccuggcuccgcg

SEQ ID NO: 1996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgccuccuggcuccgcgtt

SEQ ID NO: 1997 - RNA, 19 nt, Artificial Sequence
  source: /note="Description of Artificial Sequence: Synthetic oligonucleotide"
gcggagccaggaggcggag

SEQ ID NO: 1998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggagccaggaggcggagtt

SEQ ID NO: 1999 - RNA, 19 nt, Artificial Sequence
  source: /note="Description of Artificial Sequence: Synthetic oligonucleotide"
cuccgccuccuggcuccgc

SEQ ID NO: 2000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgccuccuggcuccgctt

SEQ ID NO: 2001 - RNA, 19 nt, Artificial Sequence
  source: /note="Description of Artificial Sequence: Synthetic oligonucleotide"
cccgggggcucggccucug

SEQ ID NO: 2002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgggggcucggccucugtt

SEQ ID NO: 2003 - RNA, 19 nt, Artificial Sequence
  source: /note="Description of Artificial Sequence: Synthetic oligonucleotide"
cagaggccgagcccccggg

SEQ ID NO: 2004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaggccgagcccccgggtt

SEQ ID NO: 2005 - RNA, 19 nt, Artificial Sequence
  source: /note="Description of Artificial Sequence: Synthetic oligonucleotide"
ccgggggcucggccucugg

SEQ ID NO: 2006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgggggcucggccucuggtt

SEQ ID NO: 2007 - RNA, 19 nt, Artificial Sequence
  source: /note="Description of Artificial Sequence: Synthetic oligonucleotide"
ccagaggccgagcccccgg

SEQ ID NO: 2008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaggccgagcccccggtt

SEQ ID NO: 2009 - RNA, 19 nt, Artificial Sequence
  source: /note="Description of Artificial Sequence: Synthetic oligonucleotide"
ggaggcacuggcggcggga

SEQ ID NO: 2010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcacuggcggcgggatt

SEQ ID NO: 2011 - RNA, 19 nt, Artificial Sequence
  source: /note="Description of Artificial Sequence: Synthetic oligonucleotide"
ucccgccgccagugccucc

SEQ ID NO: 2012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccgccgccagugccucctt

SEQ ID NO: 2013 - RNA, 19 nt, Artificial Sequence
  source: /note="Description of Artificial Sequence: Synthetic oligonucleotide"
aggcacuggcggcgggaaa

SEQ ID NO: 2014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcacuggcggcgggaaatt

SEQ ID NO: 2015 - RNA, 19 nt, Artificial Sequence
  source: /note="Description of Artificial Sequence: Synthetic oligonucleotide"
uuucccgccgccagugccu

SEQ ID NO: 2016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucccgccgccagugccutt

SEQ ID NO: 2017 - RNA, 19 nt, Artificial Sequence
  source: /note="Description of Artificial Sequence: Synthetic oligonucleotide"
gcacuggcggcgggaaagc

SEQ ID NO: 2018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacuggcggcgggaaagctt

SEQ ID NO: 2019 - RNA, 19 nt, Artificial Sequence
  source: /note="Description of Artificial Sequence: Synthetic oligonucleotide"
gcuuucccgccgccagugc

SEQ ID NO: 2020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuucccgccgccagugctt

SEQ ID NO: 2021 - RNA, 19 nt, Artificial Sequence
  source: /note="Description of Artificial Sequence: Synthetic oligonucleotide"
cacuggcggcgggaaagcg

SEQ ID NO: 2022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuggcggcgggaaagcgtt

SEQ ID NO: 2023 - RNA, 19 nt, Artificial Sequence
  source: /note="Description of Artificial Sequence: Synthetic oligonucleotide"
cgcuuucccgccgccagug

SEQ ID NO: 2024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcuuucccgccgccagugtt

SEQ ID NO: 2025 - RNA, 19 nt, Artificial Sequence
  source: /note="Description of Artificial Sequence: Synthetic oligonucleotide"
gaaagcgucagucggggcu

SEQ ID NO: 2026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaagcgucagucggggcutt

SEQ ID NO: 2027 - RNA, 19 nt, Artificial Sequence
  source: /note="Description of Artificial Sequence: Synthetic oligonucleotide"
agccccgacugacgcuuuc

SEQ ID NO: 2028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccccgacugacgcuuuctt

SEQ ID NO: 2029 - RNA, 19 nt, Artificial Sequence
  source: /note="Description of Artificial Sequence: Synthetic oligonucleotide"
ugggagccucgagcuccgg

SEQ ID NO: 2030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggagccucgagcuccggtt

SEQ ID NO: 2031 - RNA, 19 nt, Artificial Sequence
  source: /note="Description of Artificial Sequence: Synthetic oligonucleotide"
ccggagcucgaggcuccca

SEQ ID NO: 2032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagcucgaggcucccatt

SEQ ID NO: 2033 - RNA, 19 nt, Artificial Sequence
  source: /note="Description of Artificial Sequence: Synthetic oligonucleotide"
gggagccucgagcuccggg

SEQ ID NO: 2034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagccucgagcuccgggtt

SEQ ID NO: 2035 - RNA, 19 nt, Artificial Sequence
  source: /note="Description of Artificial Sequence: Synthetic oligonucleotide"
cccggagcucgaggcuccc

SEQ ID NO: 2036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggagcucgaggcuccctt

SEQ ID NO: 2037 - RNA, 19 nt, Artificial Sequence
  source: /note="Description of Artificial Sequence: Synthetic oligonucleotide"
ggagccucgagcuccgggg

SEQ ID NO: 2038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagccucgagcuccggggtt

SEQ ID NO: 2039 - RNA, 19 nt, Artificial Sequence
  source: /note="Description of Artificial Sequence: Synthetic oligonucleotide"
ccccggagcucgaggcucc

SEQ ID NO: 2040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccggagcucgaggcucctt

SEQ ID NO: 2041 - RNA, 19 nt, Artificial Sequence
  source: /note="Description of Artificial Sequence: Synthetic oligonucleotide"
gagccucgagcuccggggg

SEQ ID NO: 2042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccucgagcuccgggggtt

SEQ ID NO: 2043 - RNA, 19 nt, Artificial Sequence
  source: /note="Description of Artificial Sequence: Synthetic oligonucleotide"
cccccggagcucgaggcuc

SEQ ID NO: 2044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccggagcucgaggcuctt

SEQ ID NO: 2045 - RNA, 19 nt, Artificial Sequence
  source: /note="Description of Artificial Sequence: Synthetic oligonucleotide"
gccucgagcuccgggggug

SEQ ID NO: 2046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucgagcuccgggggugtt

SEQ ID NO: 2047 - RNA, 19 nt, Artificial Sequence
  source: /note="Description of Artificial Sequence: Synthetic oligonucleotide"
cacccccggagcucgaggc

SEQ ID NO: 2048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacccccggagcucgaggctt

SEQ ID NO: 2049 - RNA, 19 nt, Artificial Sequence
  source: /note="Description of Artificial Sequence: Synthetic oligonucleotide"
gagcuccggggguggcccc

SEQ ID NO: 2050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuccggggguggcccctt

SEQ ID NO: 2051 - RNA, 19 nt, Artificial Sequence
  source: /note="Description of Artificial Sequence: Synthetic oligonucleotide"
ggggccacccccggagcuc

SEQ ID NO: 2052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccacccccggagcuctt

SEQ ID NO: 2053 - RNA, 19 nt, Artificial Sequence
  source: /note="Description of Artificial Sequence: Synthetic oligonucleotide"
ccggggguggccccagcgg

SEQ ID NO: 2054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggggguggccccagcggtt

SEQ ID NO: 2055 - RNA, 19 nt, Artificial Sequence
  source: /note="Description of Artificial Sequence: Synthetic oligonucleotide"
ccgcuggggccacccccgg

SEQ ID NO: 2056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcuggggccacccccggtt

SEQ ID NO: 2057 - RNA, 19 nt, Artificial Sequence
  source: /note="Description of Artificial Sequence: Synthetic oligonucleotide"
ggguggccccagcggcagc

SEQ ID NO: 2058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguggccccagcggcagctt

SEQ ID NO: 2059 - RNA, 19 nt, Artificial Sequence
  source: /note="Description of Artificial Sequence: Synthetic oligonucleotide"
gcugccgcuggggccaccc

SEQ ID NO: 2060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccgcuggggccaccctt

SEQ ID NO: 2061 - RNA, 19 nt, Artificial Sequence
  source: /note="Description of Artificial Sequence: Synthetic oligonucleotide"
gcacuagcuucccgccgcc

SEQ ID NO: 2062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacuagcuucccgccgcctt

SEQ ID NO: 2063 - RNA, 19 nt, Artificial Sequence
  source: /note="Description of Artificial Sequence: Synthetic oligonucleotide"
ggcggcgggaagcuagugc

SEQ ID NO: 2064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcgggaagcuagugctt

SEQ ID NO: 2065 - RNA, 19 nt, Artificial Sequence
  source: /note="Description of Artificial Sequence: Synthetic oligonucleotide"
cacuagcuucccgccgccg

SEQ ID NO: 2066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuagcuucccgccgccgtt

SEQ ID NO: 2067 - RNA, 19 nt, Artificial Sequence
  source: /note="Description of Artificial Sequence: Synthetic oligonucleotide"
cggcggcgggaagcuagug

SEQ ID NO: 2068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcggcgggaagcuagugtt

SEQ ID NO: 2069 - RNA, 19 nt, Artificial Sequence
  source: /note="Description of Artificial Sequence: Synthetic oligonucleotide"
gcuucccgccgccgggagu

SEQ ID NO: 2070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucccgccgccgggagutt

SEQ ID NO: 2071 - RNA, 19 nt, Artificial Sequence
  source: /note="Description of Artificial Sequence: Synthetic oligonucleotide"
acucccggcggcgggaagc

SEQ ID NO: 2072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucccggcggcgggaagctt

SEQ ID NO: 2073 - RNA, 19 nt, Artificial Sequence
  source: /note="Description of Artificial Sequence: Synthetic oligonucleotide"
uucccgccgccgggaguga

SEQ ID NO: 2074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccgccgccgggagugatt

SEQ ID NO: 2075 - RNA, 19 nt, Artificial Sequence
  source: /note="Description of Artificial Sequence: Synthetic oligonucleotide"
ucacucccggcggcgggaa

SEQ ID NO: 2076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacucccggcggcgggaatt

SEQ ID NO: 2077 - RNA, 19 nt, Artificial Sequence
  source: /note="Description of Artificial Sequence: Synthetic oligonucleotide"
ugaagcugggccgugacag

SEQ ID NO: 2078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaagcugggccgugacagtt

SEQ ID NO: 2079 - RNA, 19 nt, Artificial Sequence
  source: /note="Description of Artificial Sequence: Synthetic oligonucleotide"
cugucacggcccagcuuca

SEQ ID NO: 2080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugucacggcccagcuucatt

SEQ ID NO: 2081 - RNA, 19 nt, Artificial Sequence
  source: /note="Description of Artificial Sequence: Synthetic oligonucleotide"
ggccgugacagcgggaagg

SEQ ID NO: 2082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgugacagcgggaaggtt

SEQ ID NO: 2083 - RNA, 19 nt, Artificial Sequence
  source: /note="Description of Artificial Sequence: Synthetic oligonucleotide"
ccuucccgcugucacggcc

SEQ ID NO: 2084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucccgcugucacggcctt

SEQ ID NO: 2085 - RNA, 19 nt, Artificial Sequence
  source: /note="Description of Artificial Sequence: Synthetic oligonucleotide"
cgugacagcgggaagguga

SEQ ID NO: 2086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugacagcgggaaggugatt

SEQ ID NO: 2087 - RNA, 19 nt, Artificial Sequence
  source: /note="Description of Artificial Sequence: Synthetic oligonucleotide"
ucaccuucccgcugucacg

SEQ ID NO: 2088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccuucccgcugucacgtt

SEQ ID NO: 2089 - RNA, 19 nt, Artificial Sequence
  source: /note="Description of Artificial Sequence: Synthetic oligonucleotide"
accacagugguagccacug

SEQ ID NO: 2090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacagugguagccacugtt

SEQ ID NO: 2091 - RNA, 19 nt, Artificial Sequence
  source: /note="Description of Artificial Sequence: Synthetic oligonucleotide"
caguggcuaccacuguggu

SEQ ID NO: 2092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguggcuaccacuguggutt

SEQ ID NO: 2093 - RNA, 19 nt, Artificial Sequence
  source: /note="Description of Artificial Sequence: Synthetic oligonucleotide"
acagugguagccacuguag

SEQ ID NO: 2094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagugguagccacuguagtt

SEQ ID NO: 2095 - RNA, 19 nt, Artificial Sequence
  source: /note="Description of Artificial Sequence: Synthetic oligonucleotide"
cuacaguggcuaccacugu

SEQ ID NO: 2096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaguggcuaccacugutt

SEQ ID NO: 2097 - RNA, 19 nt, Artificial Sequence
  source: /note="Description of Artificial Sequence: Synthetic oligonucleotide"
cagugguagccacuguagg

SEQ ID NO: 2098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugguagccacuguaggtt

SEQ ID NO: 2099 - RNA, 19 nt, Artificial Sequence
  source: /note="Description of Artificial Sequence: Synthetic oligonucleotide"
ccuacaguggcuaccacug

SEQ ID NO: 2100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacaguggcuaccacugtt

SEQ ID NO: 2101 - RNA, 19 nt, Artificial Sequence
  source: /note="Description of Artificial Sequence: Synthetic oligonucleotide"
cacuguaggccaaggccca

SEQ ID NO: 2102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuguaggccaaggcccatt

SEQ ID NO: 2103 - RNA, 19 nt, Artificial Sequence
  source: /note="Description of Artificial Sequence: Synthetic oligonucleotide"
ugggccuuggccuacagug

SEQ ID NO: 2104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccuuggccuacagugtt

SEQ ID NO: 2105 - RNA, 19 nt, Artificial Sequence
  source: /note="Description of Artificial Sequence: Synthetic oligonucleotide"
acuguaggccaaggcccag

SEQ ID NO: 2106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguaggccaaggcccagtt

SEQ ID NO: 2107 - RNA, 19 nt, Artificial Sequence
  source: /note="Description of Artificial Sequence: Synthetic oligonucleotide"
cugggccuuggccuacagu

SEQ ID NO: 2108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccuuggccuacagutt

SEQ ID NO: 2109 - RNA, 19 nt, Artificial Sequence
  source: /note="Description of Artificial Sequence: Synthetic oligonucleotide"
uguaggccaaggcccagag

SEQ ID NO: 2110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaggccaaggcccagagtt

SEQ ID NO: 2111 - RNA, 19 nt, Artificial Sequence
  source: /note="Description of Artificial Sequence: Synthetic oligonucleotide"
cucugggccuuggccuaca

SEQ ID NO: 2112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugggccuuggccuacatt

SEQ ID NO: 2113 - RNA, 19 nt, Artificial Sequence
  source: /note="Description of Artificial Sequence: Synthetic oligonucleotide"
guaggccaaggcccagagc

SEQ ID NO: 2114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggccaaggcccagagctt

SEQ ID NO: 2115 - RNA, 19 nt, Artificial Sequence
  source: /note="Description of Artificial Sequence: Synthetic oligonucleotide"
gcucugggccuuggccuac

SEQ ID NO: 2116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucugggccuuggccuactt

SEQ ID NO: 2117 - RNA, 19 nt, Artificial Sequence
  source: /note="Description of Artificial Sequence: Synthetic oligonucleotide"
ggaguaguauaccaggcac

SEQ ID NO: 2118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguaguauaccaggcactt

SEQ ID NO: 2119 - RNA, 19 nt, Artificial Sequence
  source: /note="Description of Artificial Sequence: Synthetic oligonucleotide"
gugccugguauacuacucc

SEQ ID NO: 2120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugccugguauacuacucctt

SEQ ID NO: 2121 - RNA, 19 nt, Artificial Sequence
  source: /note="Description of Artificial Sequence: Synthetic oligonucleotide"
guaguauaccaggcacggc

SEQ ID NO: 2122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaguauaccaggcacggctt

SEQ ID NO: 2123 - RNA, 19 nt, Artificial Sequence
  source: /note="Description of Artificial Sequence: Synthetic oligonucleotide"
gccgugccugguauacuac

SEQ ID NO: 2124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgugccugguauacuactt

SEQ ID NO: 2125 - RNA, 19 nt, Artificial Sequence
  source: /note="Description of Artificial Sequence: Synthetic oligonucleotide"
aggcacggcuggcagagac

SEQ ID NO: 2126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcacggcuggcagagactt

SEQ ID NO: 2127 - RNA, 19 nt, Artificial Sequence
  source: /note="Description of Artificial Sequence: Synthetic oligonucleotide"
gucucugccagccgugccu

SEQ ID NO: 2128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucucugccagccgugccutt

SEQ ID NO: 2129 - RNA, 19 nt, Artificial Sequence
  source: /note="Description of Artificial Sequence: Synthetic oligonucleotide"
ggcacggcuggcagagacg

SEQ ID NO: 2130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacggcuggcagagacgtt

SEQ ID NO: 2131 - RNA, 19 nt, Artificial Sequence
  source: /note="Description of Artificial Sequence: Synthetic oligonucleotide"
cgucucugccagccgugcc

SEQ ID NO: 2132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucucugccagccgugcctt

SEQ ID NO: 2133 - RNA, 19 nt, Artificial Sequence
  source: /note="Description of Artificial Sequence: Synthetic oligonucleotide"
gcacggcuggcagagacga

SEQ ID NO: 2134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacggcuggcagagacgatt

SEQ ID NO: 2135 - RNA, 19 nt, Artificial Sequence
  source: /note="Description of Artificial Sequence: Synthetic oligonucleotide"
ucgucucugccagccgugc

SEQ ID NO: 2136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgucucugccagccgugctt

SEQ ID NO: 2137 - RNA, 19 nt, Artificial Sequence
  source: /note="Description of Artificial Sequence: Synthetic oligonucleotide"
agacgagggaacugguggc

SEQ ID NO: 2138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacgagggaacugguggctt

SEQ ID NO: 2139 - RNA, 19 nt, Artificial Sequence
  source: /note="Description of Artificial Sequence: Synthetic oligonucleotide"
gccaccaguucccucgucu

SEQ ID NO: 2140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaccaguucccucgucutt

SEQ ID NO: 2141 - RNA, 19 nt, Artificial Sequence
  source: /note="Description of Artificial Sequence: Synthetic oligonucleotide"
acgagggaacugguggcca

SEQ ID NO: 2142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgagggaacugguggccatt

SEQ ID NO: 2143 - RNA, 19 nt, Artificial Sequence
  source: /note="Description of Artificial Sequence: Synthetic oligonucleotide"
uggccaccaguucccucgu

SEQ ID NO: 2144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccaccaguucccucgutt

SEQ ID NO: 2145 - RNA, 19 nt, Artificial Sequence
  source: /note="Description of Artificial Sequence: Synthetic oligonucleotide"
gagggaacugguggccauc

SEQ ID NO: 2146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaacugguggccauctt

SEQ ID NO: 2147 - RNA, 19 nt, Artificial Sequence
  source: /note="Description of Artificial Sequence: Synthetic oligonucleotide"
gauggccaccaguucccuc

SEQ ID NO: 2148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggccaccaguucccuctt

SEQ ID NO: 2149 - RNA, 19 nt, Artificial Sequence
  source: /note="Description of Artificial Sequence: Synthetic oligonucleotide"
aggacaaaagguucaagaa

SEQ ID NO: 2150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacaaaagguucaagaatt

SEQ ID NO: 2151 - RNA, 19 nt, Artificial Sequence
  source: /note="Description of Artificial Sequence: Synthetic oligonucleotide"
uucuugaaccuuuuguccu

SEQ ID NO: 2152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuugaaccuuuuguccutt

SEQ ID NO: 2153 - RNA, 19 nt, Artificial Sequence
  source: /note="Description of Artificial Sequence: Synthetic oligonucleotide"
agaaccgagaacugcagau

SEQ ID NO: 2154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccgagaacugcagautt

SEQ ID NO: 2155 - RNA, 19 nt, Artificial Sequence
  source: /note="Description of Artificial Sequence: Synthetic oligonucleotide"
aucugcaguucucgguucu

SEQ ID NO: 2156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugcaguucucgguucutt

SEQ ID NO: 2157 - RNA, 19 nt, Artificial Sequence
  source: /note="Description of Artificial Sequence: Synthetic oligonucleotide"
agaacugcagauuaugcgu

SEQ ID NO: 2158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaacugcagauuaugcgutt

SEQ ID NO: 2159 - RNA, 19 nt, Artificial Sequence
  source: /note="Description of Artificial Sequence: Synthetic oligonucleotide"
acgcauaaucugcaguucu

SEQ ID NO: 2160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgcauaaucugcaguucutt

SEQ ID NO: 2161 - RNA, 19 nt, Artificial Sequence
  source: /note="Description of Artificial Sequence: Synthetic oligonucleotide"
gaacugcagauuaugcgua

SEQ ID NO: 2162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacugcagauuaugcguatt

SEQ ID NO: 2163 - RNA, 19 nt, Artificial Sequence
  source: /note="Description of Artificial Sequence: Synthetic oligonucleotide"
uacgcauaaucugcaguuc

SEQ ID NO: 2164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacgcauaaucugcaguuctt

SEQ ID NO: 2165 - RNA, 19 nt, Artificial Sequence
  source: /note="Description of Artificial Sequence: Synthetic oligonucleotide"
auauugugaggcugcggua

SEQ ID NO: 2166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauugugaggcugcgguatt

SEQ ID NO: 2167 - RNA, 19 nt, Artificial Sequence
  source: /note="Description of Artificial Sequence: Synthetic oligonucleotide"
uaccgcagccucacaauau

SEQ ID NO: 2168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgcagccucacaauautt

SEQ ID NO: 2169 - RNA, 19 nt, Artificial Sequence
  source: /note="Description of Artificial Sequence: Synthetic oligonucleotide"
uauugugaggcugcgguac

SEQ ID NO: 2170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauugugaggcugcgguactt

SEQ ID NO: 2171 - RNA, 19 nt, Artificial Sequence
  source: /note="Description of Artificial Sequence: Synthetic oligonucleotide"
guaccgcagccucacaaua

SEQ ID NO: 2172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccgcagccucacaauatt

SEQ ID NO: 2173 - RNA, 19 nt, Artificial Sequence
  source: /note="Description of Artificial Sequence: Synthetic oligonucleotide"
auugugaggcugcgguacu

SEQ ID NO: 2174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugugaggcugcgguacutt

SEQ ID NO: 2175 - RNA, 19 nt, Artificial Sequence
  source: /note="Description of Artificial Sequence: Synthetic oligonucleotide"
aguaccgcagccucacaau

SEQ ID NO: 2176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaccgcagccucacaautt

SEQ ID NO: 2177 - RNA, 19 nt, Artificial Sequence
  source: /note="Description of Artificial Sequence: Synthetic oligonucleotide"
ggggagaagaaggacgagc

SEQ ID NO: 2178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagaagaaggacgagctt

SEQ ID NO: 2179 - RNA, 19 nt, Artificial Sequence
  source: /note="Description of Artificial Sequence: Synthetic oligonucleotide"
gcucguccuucuucucccc

SEQ ID NO: 2180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucguccuucuucucccctt

SEQ ID NO: 2181 - RNA, 19 nt, Artificial Sequence
  source: /note="Description of Artificial Sequence: Synthetic oligonucleotide"
ggccaagcugaucaccccu

SEQ ID NO: 2182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaagcugaucaccccutt

SEQ ID NO: 2183 - RNA, 19 nt, Artificial Sequence
  source: /note="Description of Artificial Sequence: Synthetic oligonucleotide"
aggggugaucagcuuggcc

SEQ ID NO: 2184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggugaucagcuuggcctt

SEQ ID NO: 2185 - RNA, 19 nt, Artificial Sequence
  source: /note="Description of Artificial Sequence: Synthetic oligonucleotide"
caagcugaucaccccuauc

SEQ ID NO: 2186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcugaucaccccuauctt

SEQ ID NO: 2187 - RNA, 19 nt, Artificial Sequence
  source: /note="Description of Artificial Sequence: Synthetic oligonucleotide"
gauaggggugaucagcuug

SEQ ID NO: 2188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauaggggugaucagcuugtt

SEQ ID NO: 2189 - RNA, 19 nt, Artificial Sequence
  source: /note="Description of Artificial Sequence: Synthetic oligonucleotide"
cggagcuuggccuacaucc

SEQ ID NO: 2190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagcuuggccuacaucctt

SEQ ID NO: 2191 - RNA, 19 nt, Artificial Sequence
  source: /note="Description of Artificial Sequence: Synthetic oligonucleotide"
ggauguaggccaagcuccg

SEQ ID NO: 2192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauguaggccaagcuccgtt

SEQ ID NO: 2193 - RNA, 19 nt, Artificial Sequence
  source: /note="Description of Artificial Sequence: Synthetic oligonucleotide"
ggagcuuggccuacaucca

SEQ ID NO: 2194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcuuggccuacauccatt

SEQ ID NO: 2195 - RNA, 19 nt, Artificial Sequence
  source: /note="Description of Artificial Sequence: Synthetic oligonucleotide"
uggauguaggccaagcucc

SEQ ID NO: 2196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggauguaggccaagcucctt

SEQ ID NO: 2197 - RNA, 19 nt, Artificial Sequence
  source: /note="Description of Artificial Sequence: Synthetic oligonucleotide"
gagcuuggccuacauccac

SEQ ID NO: 2198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuuggccuacauccactt

SEQ ID NO: 2199 - RNA, 19 nt, Artificial Sequence
  source: /note="Description of Artificial Sequence: Synthetic oligonucleotide"
guggauguaggccaagcuc

SEQ ID NO: 2200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggauguaggccaagcuctt

SEQ ID NO: 2201 - RNA, 19 nt, Artificial Sequence
  source: /note="Description of Artificial Sequence: Synthetic oligonucleotide"
cuuggccuacauccacucc

SEQ ID NO: 2202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggccuacauccacucctt

SEQ ID NO: 2203 - RNA, 19 nt, Artificial Sequence
  source: /note="Description of Artificial Sequence: Synthetic oligonucleotide"
ggaguggauguaggccaag

SEQ ID NO: 2204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguggauguaggccaagtt

SEQ ID NO: 2205 - RNA, 19 nt, Artificial Sequence
  source: /note="Description of Artificial Sequence: Synthetic oligonucleotide"
uggccuacauccacuccca

SEQ ID NO: 2206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccuacauccacucccatt

SEQ ID NO: 2207 - RNA, 19 nt, Artificial Sequence
  source: /note="Description of Artificial Sequence: Synthetic oligonucleotide"
ugggaguggauguaggcca

SEQ ID NO: 2208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggaguggauguaggccatt

SEQ ID NO: 2209 - RNA, 19 nt, Artificial Sequence
  source: /note="Description of Artificial Sequence: Synthetic oligonucleotide"
ccacucccaaggugugugu

SEQ ID NO: 2210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacucccaaggugugugutt

SEQ ID NO: 2211 - RNA, 19 nt, Artificial Sequence
  source: /note="Description of Artificial Sequence: Synthetic oligonucleotide"
acacacaccuugggagugg

SEQ ID NO: 2212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacacaccuugggaguggtt

SEQ ID NO: 2213 - RNA, 19 nt, Artificial Sequence
  source: /note="Description of Artificial Sequence: Synthetic oligonucleotide"
accgugacaucaagcccca

SEQ ID NO: 2214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgugacaucaagccccatt

SEQ ID NO: 2215 - RNA, 19 nt, Artificial Sequence
  source: /note="Description of Artificial Sequence: Synthetic oligonucleotide"
uggggcuugaugucacggu

SEQ ID NO: 2216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggcuugaugucacggutt

SEQ ID NO: 2217 - RNA, 19 nt, Artificial Sequence
  source: /note="Description of Artificial Sequence: Synthetic oligonucleotide"
ccgugacaucaagccccag

SEQ ID NO: 2218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgugacaucaagccccagtt

SEQ ID NO: 2219 - RNA, 19 nt, Artificial Sequence
  source: /note="Description of Artificial Sequence: Synthetic oligonucleotide"
cuggggcuugaugucacgg

SEQ ID NO: 2220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggcuugaugucacggtt

SEQ ID NO: 2221 - RNA, 19 nt, Artificial Sequence
  source: /note="Description of Artificial Sequence: Synthetic oligonucleotide"
cccagaauuugcuugugga

SEQ ID NO: 2222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagaauuugcuuguggatt

SEQ ID NO: 2223 - RNA, 19 nt, Artificial Sequence
  source: /note="Description of Artificial Sequence: Synthetic oligonucleotide"
uccacaagcaaauucuggg

SEQ ID NO: 2224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacaagcaaauucugggtt

SEQ ID NO: 2225 - RNA, 19 nt, Artificial Sequence
  source: /note="Description of Artificial Sequence: Synthetic oligonucleotide"
cagaauuugcuuguggacc

SEQ ID NO: 2226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaauuugcuuguggacctt

SEQ ID NO: 2227 - RNA, 19 nt, Artificial Sequence
  source: /note="Description of Artificial Sequence: Synthetic oligonucleotide"
gguccacaagcaaauucug

SEQ ID NO: 2228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccacaagcaaauucugtt

SEQ ID NO: 2229 - RNA, 19 nt, Artificial Sequence
  source: /note="Description of Artificial Sequence: Synthetic oligonucleotide"
caaagcagcugguucgggg

SEQ ID NO: 2230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagcagcugguucggggtt

SEQ ID NO: 2231 - RNA, 19 nt, Artificial Sequence
  source: /note="Description of Artificial Sequence: Synthetic oligonucleotide"
ccccgaaccagcugcuuug

SEQ ID NO: 2232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgaaccagcugcuuugtt

SEQ ID NO: 2233 - RNA, 19 nt, Artificial Sequence
  source: /note="Description of Artificial Sequence: Synthetic oligonucleotide"
aagcagcugguucgggggg

SEQ ID NO: 2234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcagcugguucggggggtt

SEQ ID NO: 2235 - RNA, 19 nt, Artificial Sequence
  source: /note="Description of Artificial Sequence: Synthetic oligonucleotide"
ccccccgaaccagcugcuu

SEQ ID NO: 2236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccccgaaccagcugcuutt

SEQ ID NO: 2237 - RNA, 19 nt, Artificial Sequence
  source: /note="Description of Artificial Sequence: Synthetic oligonucleotide"
ugguucggggggagcccaa

SEQ ID NO: 2238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguucggggggagcccaatt

SEQ ID NO: 2239 - RNA, 19 nt, Artificial Sequence
  source: /note="Description of Artificial Sequence: Synthetic oligonucleotide"
uugggcuccccccgaacca

SEQ ID NO: 2240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggcuccccccgaaccatt

SEQ ID NO: 2241 - RNA, 19 nt, Artificial Sequence
  source: /note="Description of Artificial Sequence: Synthetic oligonucleotide"
uucggggggagcccaaugu

SEQ ID NO: 2242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucggggggagcccaaugutt

SEQ ID NO: 2243 - RNA, 19 nt, Artificial Sequence
  source: /note="Description of Artificial Sequence: Synthetic oligonucleotide"
acauugggcuccccccgaa

SEQ ID NO: 2244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauugggcuccccccgaatt

SEQ ID NO: 2245 - RNA, 19 nt, Artificial Sequence
  source: /note="Description of Artificial Sequence: Synthetic oligonucleotide"
ucggggggagcccaaugug

SEQ ID NO: 2246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggggggagcccaaugugtt

SEQ ID NO: 2247 - RNA, 19 nt, Artificial Sequence
  source: /note="Description of Artificial Sequence: Synthetic oligonucleotide"
cacauugggcuccccccga

SEQ ID NO: 2248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacauugggcuccccccgatt

SEQ ID NO: 2249 - RNA, 19 nt, Artificial Sequence
  source: /note="Description of Artificial Sequence: Synthetic oligonucleotide"
ggggggagcccaauguguc

SEQ ID NO: 2250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggggagcccaauguguctt

SEQ ID NO: 2251 - RNA, 19 nt, Artificial Sequence
  source: /note="Description of Artificial Sequence: Synthetic oligonucleotide"
gacacauugggcucccccc

SEQ ID NO: 2252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacauugggcucccccctt

SEQ ID NO: 2253 - RNA, 19 nt, Artificial Sequence
  source: /note="Description of Artificial Sequence: Synthetic oligonucleotide"
ccaauguguccuacaucug

SEQ ID NO: 2254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaauguguccuacaucugtt

SEQ ID NO: 2255 - RNA, 19 nt, Artificial Sequence
  source: /note="Description of Artificial Sequence: Synthetic oligonucleotide"
cagauguaggacacauugg

SEQ ID NO: 2256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauguaggacacauuggtt

SEQ ID NO: 2257 - RNA, 19 nt, Artificial Sequence
  source: /note="Description of Artificial Sequence: Synthetic oligonucleotide"
caauguguccuacaucugc

SEQ ID NO: 2258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauguguccuacaucugctt

SEQ ID NO: 2259 - RNA, 19 nt, Artificial Sequence
  source: /note="Description of Artificial Sequence: Synthetic oligonucleotide"
gcagauguaggacacauug

SEQ ID NO: 2260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagauguaggacacauugtt

SEQ ID NO: 2261 - RNA, 19 nt, Artificial Sequence
  source: /note="Description of Artificial Sequence: Synthetic oligonucleotide"
cugcucucgguacuaccgu

SEQ ID NO: 2262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcucucgguacuaccgutt

SEQ ID NO: 2263 - RNA, 19 nt, Artificial Sequence
  source: /note="Description of Artificial Sequence: Synthetic oligonucleotide"
acgguaguaccgagagcag

SEQ ID NO: 2264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgguaguaccgagagcagtt

SEQ ID NO: 2265 - RNA, 19 nt, Artificial Sequence
  source: /note="Description of Artificial Sequence: Synthetic oligonucleotide"
accgugcuccagaacucau

SEQ ID NO: 2266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgugcuccagaacucautt

SEQ ID NO: 2267 - RNA, 19 nt, Artificial Sequence
  source: /note="Description of Artificial Sequence: Synthetic oligonucleotide"
augaguucuggagcacggu

SEQ ID NO: 2268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaguucuggagcacggutt

SEQ ID NO: 2269 - RNA, 19 nt, Artificial Sequence
  source: /note="Description of Artificial Sequence: Synthetic oligonucleotide"
cgugcuccagaacucaucu

SEQ ID NO: 2270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugcuccagaacucaucutt

SEQ ID NO: 2271 - RNA, 19 nt, Artificial Sequence
  source: /note="Description of Artificial Sequence: Synthetic oligonucleotide"
agaugaguucuggagcacg

SEQ ID NO: 2272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugaguucuggagcacgtt

SEQ ID NO: 2273 - RNA, 19 nt, Artificial Sequence
  source: /note="Description of Artificial Sequence: Synthetic oligonucleotide"
cuccagaacucaucuuugg

SEQ ID NO: 2274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccagaacucaucuuuggtt

SEQ ID NO: 2275 - RNA, 19 nt, Artificial Sequence
  source: /note="Description of Artificial Sequence: Synthetic oligonucleotide"
ccaaagaugaguucuggag

SEQ ID NO: 2276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaagaugaguucuggagtt

SEQ ID NO: 2277 - RNA, 19 nt, Artificial Sequence
  source: /note="Description of Artificial Sequence: Synthetic oligonucleotide"
agaacucaucuuuggagcc

SEQ ID NO: 2278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaacucaucuuuggagcctt

SEQ ID NO: 2279 - RNA, 19 nt, Artificial Sequence
  source: /note="Description of Artificial Sequence: Synthetic oligonucleotide"
ggcuccaaagaugaguucu

SEQ ID NO: 2280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccaaagaugaguucutt

SEQ ID NO: 2281 - RNA, 19 nt, Artificial Sequence
  source: /note="Description of Artificial Sequence: Synthetic oligonucleotide"
acucaucuuuggagccaca

SEQ ID NO: 2282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucaucuuuggagccacatt

SEQ ID NO: 2283 - RNA, 19 nt, Artificial Sequence
  source: /note="Description of Artificial Sequence: Synthetic oligonucleotide"
uguggcuccaaagaugagu

SEQ ID NO: 2284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggcuccaaagaugagutt

SEQ ID NO: 2285 - RNA, 19 nt, Artificial Sequence
  source: /note="Description of Artificial Sequence: Synthetic oligonucleotide"
caucuuuggagccacagau

SEQ ID NO: 2286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuuuggagccacagautt

SEQ ID NO: 2287 - RNA, 19 nt, Artificial Sequence
  source: /note="Description of Artificial Sequence: Synthetic oligonucleotide"
aucuguggcuccaaagaug

SEQ ID NO: 2288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuguggcuccaaagaugtt

SEQ ID NO: 2289 - RNA, 19 nt, Artificial Sequence
  source: /note="Description of Artificial Sequence: Synthetic oligonucleotide"
aucuuuggagccacagauu

SEQ ID NO: 2290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuuuggagccacagauutt

SEQ ID NO: 2291 - RNA, 19 nt, Artificial Sequence
  source: /note="Description of Artificial Sequence: Synthetic oligonucleotide"
aaucuguggcuccaaagau

SEQ ID NO: 2292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucuguggcuccaaagautt

SEQ ID NO: 2293 - RNA, 19 nt, Artificial Sequence
  source: /note="Description of Artificial Sequence: Synthetic oligonucleotide"
ucguccaucgauguguggu

SEQ ID NO: 2294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucguccaucgauguguggutt

SEQ ID NO: 2295 - RNA, 19 nt, Artificial Sequence
  source: /note="Description of Artificial Sequence: Synthetic oligonucleotide"
accacacaucgauggacga

SEQ ID NO: 2296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacacaucgauggacgatt

SEQ ID NO: 2297 - RNA, 19 nt, Artificial Sequence
  source: /note="Description of Artificial Sequence: Synthetic oligonucleotide"
uguggucggcuggcugugu

SEQ ID NO: 2298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggucggcuggcugugutt

SEQ ID NO: 2299 - RNA, 19 nt, Artificial Sequence
  source: /note="Description of Artificial Sequence: Synthetic oligonucleotide"
acacagccagccgaccaca

SEQ ID NO: 2300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacagccagccgaccacatt

SEQ ID NO: 2301 - RNA, 19 nt, Artificial Sequence
  source: /note="Description of Artificial Sequence: Synthetic oligonucleotide"
guggucggcuggcugugua

SEQ ID NO: 2302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggucggcuggcuguguatt

SEQ ID NO: 2303 - RNA, 19 nt, Artificial Sequence
  source: /note="Description of Artificial Sequence: Synthetic oligonucleotide"
uacacagccagccgaccac

SEQ ID NO: 2304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacagccagccgaccactt

SEQ ID NO: 2305 - RNA, 19 nt, Artificial Sequence
  source: /note="Description of Artificial Sequence: Synthetic oligonucleotide"
uggucggcuggcuguguac

SEQ ID NO: 2306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggucggcuggcuguguactt

SEQ ID NO: 2307 - RNA, 19 nt, Artificial Sequence
  source: /note="Description of Artificial Sequence: Synthetic oligonucleotide"
guacacagccagccgacca

SEQ ID NO: 2308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacacagccagccgaccatt

SEQ ID NO: 2309 - RNA, 19 nt, Artificial Sequence
  source: /note="Description of Artificial Sequence: Synthetic oligonucleotide"
cuguguacuugcugagcua

SEQ ID NO: 2310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguguacuugcugagcuatt

SEQ ID NO: 2311 - RNA, 19 nt, Artificial Sequence
  source: /note="Description of Artificial Sequence: Synthetic oligonucleotide"
uagcucagcaaguacacag

SEQ ID NO: 2312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcucagcaaguacacagtt

SEQ ID NO: 2313 - RNA, 19 nt, Artificial Sequence
  source: /note="Description of Artificial Sequence: Synthetic oligonucleotide"
guguacuugcugagcuacu

SEQ ID NO: 2314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacuugcugagcuacutt

SEQ ID NO: 2315 - RNA, 19 nt, Artificial Sequence
  source: /note="Description of Artificial Sequence: Synthetic oligonucleotide"
aguagcucagcaaguacac

SEQ ID NO: 2316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguagcucagcaaguacactt

SEQ ID NO: 2317 - RNA, 19 nt, Artificial Sequence
  source: /note="Description of Artificial Sequence: Synthetic oligonucleotide"
uguacuugcugagcuacuu

SEQ ID NO: 2318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacuugcugagcuacuutt

SEQ ID NO: 2319 - RNA, 19 nt, Artificial Sequence
  source: /note="Description of Artificial Sequence: Synthetic oligonucleotide"
aaguagcucagcaaguaca

SEQ ID NO: 2320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguagcucagcaaguacatt

SEQ ID NO: 2321 - RNA, 19 nt, Artificial Sequence
  source: /note="Description of Artificial Sequence: Synthetic oligonucleotide"
cuugcugagcuacuucucg

SEQ ID NO: 2322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugcugagcuacuucucgtt

SEQ ID NO: 2323 - RNA, 19 nt, Artificial Sequence
  source: /note="Description of Artificial Sequence: Synthetic oligonucleotide"
cgagaaguagcucagcaag

SEQ ID NO: 2324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagaaguagcucagcaagtt

SEQ ID NO: 2325 - RNA, 19 nt, Artificial Sequence
  source: /note="Description of Artificial Sequence: Synthetic oligonucleotide"
agcuacuucucggccagcc

SEQ ID NO: 2326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuacuucucggccagcctt

SEQ ID NO: 2327 - RNA, 19 nt, Artificial Sequence
  source: /note="Description of Artificial Sequence: Synthetic oligonucleotide"
ggcuggccgagaaguagcu

SEQ ID NO: 2328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuggccgagaaguagcutt

SEQ ID NO: 2329 - RNA, 19 nt, Artificial Sequence
  source: /note="Description of Artificial Sequence: Synthetic oligonucleotide"
ccagcccaucuucccuggg

SEQ ID NO: 2330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcccaucuucccugggtt

SEQ ID NO: 2331 - RNA, 19 nt, Artificial Sequence
  source: /note="Description of Artificial Sequence: Synthetic oligonucleotide"
cccagggaagaugggcugg

SEQ ID NO: 2332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagggaagaugggcuggtt

SEQ ID NO: 2333 - RNA, 19 nt, Artificial Sequence
  source: /note="Description of Artificial Sequence: Synthetic oligonucleotide"
aucuucccuggggacagug

SEQ ID NO: 2334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuucccuggggacagugtt

SEQ ID NO: 2335 - RNA, 19 nt, Artificial Sequence
  source: /note="Description of Artificial Sequence: Synthetic oligonucleotide"
cacuguccccagggaagau

SEQ ID NO: 2336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuguccccagggaagautt

SEQ ID NO: 2337 - RNA, 19 nt, Artificial Sequence
  source: /note="Description of Artificial Sequence: Synthetic oligonucleotide"
cgagagaugaacccuaacu

SEQ ID NO: 2338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagagaugaacccuaacutt

SEQ ID NO: 2339 - RNA, 19 nt, Artificial Sequence
  source: /note="Description of Artificial Sequence: Synthetic oligonucleotide"
aguuaggguucaucucucg

SEQ ID NO: 2340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuaggguucaucucucgtt

SEQ ID NO: 2341 - RNA, 19 nt, Artificial Sequence
  source: /note="Description of Artificial Sequence: Synthetic oligonucleotide"
cagaucaaagcucacccuu

SEQ ID NO: 2342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaucaaagcucacccuutt

SEQ ID NO: 2343 - RNA, 19 nt, Artificial Sequence
  source: /note="Description of Artificial Sequence: Synthetic oligonucleotide"
aagggugagcuuugaucug

SEQ ID NO: 2344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggugagcuuugaucugtt

SEQ ID NO: 2345 - RNA, 19 nt, Artificial Sequence
  source: /note="Description of Artificial Sequence: Synthetic oligonucleotide"
agaucaaagcucacccuug

SEQ ID NO: 2346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaucaaagcucacccuugtt

SEQ ID NO: 2347 - RNA, 19 nt, Artificial Sequence
  source: /note="Description of Artificial Sequence: Synthetic oligonucleotide"
caagggugagcuuugaucu

SEQ ID NO: 2348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagggugagcuuugaucutt

SEQ ID NO: 2349 - RNA, 19 nt, Artificial Sequence
  source: /note="Description of Artificial Sequence: Synthetic oligonucleotide"
ucaaagcucacccuuggac

SEQ ID NO: 2350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaagcucacccuuggactt

SEQ ID NO: 2351 - RNA, 19 nt, Artificial Sequence
  source: /note="Description of Artificial Sequence: Synthetic oligonucleotide"
guccaagggugagcuuuga

SEQ ID NO: 2352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaagggugagcuuugatt

SEQ ID NO: 2353 - RNA, 19 nt, Artificial Sequence
  source: /note="Description of Artificial Sequence: Synthetic oligonucleotide"
caaagguguucaaaucuuc

SEQ ID NO: 2354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagguguucaaaucuuctt

SEQ ID NO: 2355 - RNA, 19 nt, Artificial Sequence
  source: /note="Description of Artificial Sequence: Synthetic oligonucleotide"
gaagauuugaacaccuuug

SEQ ID NO: 2356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagauuugaacaccuuugtt

SEQ ID NO: 2357 - RNA, 19 nt, Artificial Sequence
  source: /note="Description of Artificial Sequence: Synthetic oligonucleotide"
aaagguguucaaaucuuca

SEQ ID NO: 2358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagguguucaaaucuucatt

SEQ ID NO: 2359 - RNA, 19 nt, Artificial Sequence
  source: /note="Description of Artificial Sequence: Synthetic oligonucleotide"
ugaagauuugaacaccuuu

SEQ ID NO: 2360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaagauuugaacaccuuutt

SEQ ID NO: 2361 - RNA, 19 nt, Artificial Sequence
  source: /note="Description of Artificial Sequence: Synthetic oligonucleotide"
caaaucuucaaagacacca

SEQ ID NO: 2362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaucuucaaagacaccatt

SEQ ID NO: 2363 - RNA, 19 nt, Artificial Sequence
  source: /note="Description of Artificial Sequence: Synthetic oligonucleotide"
uggugucuuugaagauuug

SEQ ID NO: 2364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugucuuugaagauuugtt

SEQ ID NO: 2365 - RNA, 19 nt, Artificial Sequence
  source: /note="Description of Artificial Sequence: Synthetic oligonucleotide"
aaagacaccaccugaggcc

SEQ ID NO: 2366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagacaccaccugaggcctt

SEQ ID NO: 2367 - RNA, 19 nt, Artificial Sequence
  source: /note="Description of Artificial Sequence: Synthetic oligonucleotide"
ggccucagguggugucuuu

SEQ ID NO: 2368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccucagguggugucuuutt

SEQ ID NO: 2369 - RNA, 19 nt, Artificial Sequence
  source: /note="Description of Artificial Sequence: Synthetic oligonucleotide"
agacaccaccugaggccau

SEQ ID NO: 2370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacaccaccugaggccautt

SEQ ID NO: 2371 - RNA, 19 nt, Artificial Sequence
  source: /note="Description of Artificial Sequence: Synthetic oligonucleotide"
auggccucagguggugucu

SEQ ID NO: 2372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggccucagguggugucutt

SEQ ID NO: 2373 - RNA, 19 nt, Artificial Sequence
  source: /note="Description of Artificial Sequence: Synthetic oligonucleotide"
gacaccaccugaggccauu

SEQ ID NO: 2374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaccaccugaggccauutt

SEQ ID NO: 2375 - RNA, 19 nt, Artificial Sequence
  source: /note="Description of Artificial Sequence: Synthetic oligonucleotide"
aauggccucaggugguguc

SEQ ID NO: 2376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggccucaggugguguctt

SEQ ID NO: 2377 - RNA, 19 nt, Artificial Sequence
  source: /note="Description of Artificial Sequence: Synthetic oligonucleotide"
accaccugaggccauugca

SEQ ID NO: 2378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaccugaggccauugcatt

SEQ ID NO: 2379 - RNA, 19 nt, Artificial Sequence
  source: /note="Description of Artificial Sequence: Synthetic oligonucleotide"
ugcaauggccucagguggu

SEQ ID NO: 2380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaauggccucagguggutt

SEQ ID NO: 2381 - RNA, 19 nt, Artificial Sequence
  source: /note="Description of Artificial Sequence: Synthetic oligonucleotide"
accugaggccauugcacuc

SEQ ID NO: 2382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accugaggccauugcacuctt

SEQ ID NO: 2383 - RNA, 19 nt, Artificial Sequence
  source: /note="Description of Artificial Sequence: Synthetic oligonucleotide"
gagugcaauggccucaggu

SEQ ID NO: 2384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagugcaauggccucaggutt

SEQ ID NO: 2385 - RNA, 19 nt, Artificial Sequence
  source: /note="Description of Artificial Sequence: Synthetic oligonucleotide"
cugaggccauugcacucug

SEQ ID NO: 2386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaggccauugcacucugtt

SEQ ID NO: 2387 - RNA, 19 nt, Artificial Sequence
  source: /note="Description of Artificial Sequence: Synthetic oligonucleotide"
cagagugcaauggccucag

SEQ ID NO: 2388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagugcaauggccucagtt

SEQ ID NO: 2389 - RNA, 19 nt, Artificial Sequence
  source: /note="Description of Artificial Sequence: Synthetic oligonucleotide"
cauugcacucugcucuagc

SEQ ID NO: 2390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauugcacucugcucuagctt

SEQ ID NO: 2391 - RNA, 19 nt, Artificial Sequence
  source: /note="Description of Artificial Sequence: Synthetic oligonucleotide"
gcuagagcagagugcaaug

SEQ ID NO: 2392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagagcagagugcaaugtt

SEQ ID NO: 2393 - RNA, 19 nt, Artificial Sequence
  source: /note="Description of Artificial Sequence: Synthetic oligonucleotide"
ucugcucuagccuacugga

SEQ ID NO: 2394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcucuagccuacuggatt

SEQ ID NO: 2395 - RNA, 19 nt, Artificial Sequence
  source: /note="Description of Artificial Sequence: Synthetic oligonucleotide"
uccaguaggcuagagcaga

SEQ ID NO: 2396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaguaggcuagagcagatt

SEQ ID NO: 2397 - RNA, 19 nt, Artificial Sequence
  source: /note="Description of Artificial Sequence: Synthetic oligonucleotide"
cuggaguacacgccauccu

SEQ ID NO: 2398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaguacacgccauccutt

SEQ ID NO: 2399 - RNA, 19 nt, Artificial Sequence
  source: /note="Description of Artificial Sequence: Synthetic oligonucleotide"
aggauggcguguacuccag

SEQ ID NO: 2400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggauggcguguacuccagtt

SEQ ID NO: 2401 - RNA, 19 nt, Artificial Sequence
  source: /note="Description of Artificial Sequence: Synthetic oligonucleotide"
gaguacacgccauccucaa

SEQ ID NO: 2402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguacacgccauccucaatt

SEQ ID NO: 2403 - RNA, 19 nt, Artificial Sequence
  source: /note="Description of Artificial Sequence: Synthetic oligonucleotide"
uugaggauggcguguacuc

SEQ ID NO: 2404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaggauggcguguacuctt

SEQ ID NO: 2405 - RNA, 19 nt, Artificial Sequence
  source: /note="Description of Artificial Sequence: Synthetic oligonucleotide"
uacacgccauccucaaggc

SEQ ID NO: 2406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacgccauccucaaggctt

SEQ ID NO: 2407 - RNA, 19 nt, Artificial Sequence
  source: /note="Description of Artificial Sequence: Synthetic oligonucleotide"
gccuugaggauggcgugua

SEQ ID NO: 2408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuugaggauggcguguatt

SEQ ID NO: 2409 - RNA, 19 nt, Artificial Sequence
  source: /note="Description of Artificial Sequence: Synthetic oligonucleotide"
ggcucuccccacucgaggc

SEQ ID NO: 2410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucuccccacucgaggctt

SEQ ID NO: 2411 - RNA, 19 nt, Artificial Sequence
  source: /note="Description of Artificial Sequence: Synthetic oligonucleotide"
gccucgaguggggagagcc

SEQ ID NO: 2412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucgaguggggagagcctt

SEQ ID NO: 2413 - RNA, 19 nt, Artificial Sequence
  source: /note="Description of Artificial Sequence: Synthetic oligonucleotide"
gcucuccccacucgaggcu

SEQ ID NO: 2414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuccccacucgaggcutt

SEQ ID NO: 2415 - RNA, 19 nt, Artificial Sequence
  source: /note="Description of Artificial Sequence: Synthetic oligonucleotide"
agccucgaguggggagagc

SEQ ID NO: 2416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccucgaguggggagagctt

SEQ ID NO: 2417 - RNA, 19 nt, Artificial Sequence
  source: /note="Description of Artificial Sequence: Synthetic oligonucleotide"
cucuccccacucgaggcuu

SEQ ID NO: 2418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuccccacucgaggcuutt

SEQ ID NO: 2419 - RNA, 19 nt, Artificial Sequence
  source: /note="Description of Artificial Sequence: Synthetic oligonucleotide"
aagccucgaguggggagag

SEQ ID NO: 2420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccucgaguggggagagtt

SEQ ID NO: 2421 - RNA, 19 nt, Artificial Sequence
  source: /note="Description of Artificial Sequence: Synthetic oligonucleotide"
cgaugaacugcggagacuc

SEQ ID NO: 2422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaugaacugcggagacuctt

SEQ ID NO: 2423 - RNA, 19 nt, Artificial Sequence
  source: /note="Description of Artificial Sequence: Synthetic oligonucleotide"
gagucuccgcaguucaucg

SEQ ID NO: 2424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagucuccgcaguucaucgtt

SEQ ID NO: 2425 - RNA, 19 nt, Artificial Sequence
  source: /note="Description of Artificial Sequence: Synthetic oligonucleotide"
gcggagacucggagcccag

SEQ ID NO: 2426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggagacucggagcccagtt

SEQ ID NO: 2427 - RNA, 19 nt, Artificial Sequence
  source: /note="Description of Artificial Sequence: Synthetic oligonucleotide"
cugggcuccgagucuccgc

SEQ ID NO: 2428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggcuccgagucuccgctt

SEQ ID NO: 2429 - RNA, 19 nt, Artificial Sequence
  source: /note="Description of Artificial Sequence: Synthetic oligonucleotide"
cggagacucggagcccagc

SEQ ID NO: 2430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagacucggagcccagctt

SEQ ID NO: 2431 - RNA, 19 nt, Artificial Sequence
  source: /note="Description of Artificial Sequence: Synthetic oligonucleotide"
gcugggcuccgagucuccg

SEQ ID NO: 2432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggcuccgagucuccgtt

SEQ ID NO: 2433 - RNA, 19 nt, Artificial Sequence
  source: /note="Description of Artificial Sequence: Synthetic oligonucleotide"
ggagacucggagcccagcu

SEQ ID NO: 2434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagacucggagcccagcutt

SEQ ID NO: 2435 - RNA, 19 nt, Artificial Sequence
  source: /note="Description of Artificial Sequence: Synthetic oligonucleotide"
agcugggcuccgagucucc

SEQ ID NO: 2436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugggcuccgagucucctt

SEQ ID NO: 2437 - RNA, 19 nt, Artificial Sequence
  source: /note="Description of Artificial Sequence: Synthetic oligonucleotide"
agacucggagcccagcucc

SEQ ID NO: 2438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacucggagcccagcucctt

SEQ ID NO: 2439 - RNA, 19 nt, Artificial Sequence
  source: /note="Description of Artificial Sequence: Synthetic oligonucleotide"
ggagcugggcuccgagucu

SEQ ID NO: 2440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcugggcuccgagucutt

SEQ ID NO: 2441 - RNA, 19 nt, Artificial Sequence
  source: /note="Description of Artificial Sequence: Synthetic oligonucleotide"
acucggagcccagcucccc

SEQ ID NO: 2442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucggagcccagcucccctt

SEQ ID NO: 2443 - RNA, 19 nt, Artificial Sequence
  source: /note="Description of Artificial Sequence: Synthetic oligonucleotide"
ggggagcugggcuccgagu

SEQ ID NO: 2444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagcugggcuccgagutt

SEQ ID NO: 2445 - RNA, 19 nt, Artificial Sequence
  source: /note="Description of Artificial Sequence: Synthetic oligonucleotide"
ucggagcccagcuccccaa

SEQ ID NO: 2446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggagcccagcuccccaatt

SEQ ID NO: 2447 - RNA, 19 nt, Artificial Sequence
  source: /note="Description of Artificial Sequence: Synthetic oligonucleotide"
uuggggagcugggcuccga

SEQ ID NO: 2448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggggagcugggcuccgatt

SEQ ID NO: 2449 - RNA, 19 nt, Artificial Sequence
  source: /note="Description of Artificial Sequence: Synthetic oligonucleotide"
acgaccgcccgcuuccccc

SEQ ID NO: 2450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgaccgcccgcuuccccctt

SEQ ID NO: 2451 - RNA, 19 nt, Artificial Sequence
  source: /note="Description of Artificial Sequence: Synthetic oligonucleotide"
gggggaagcgggcggucgu

SEQ ID NO: 2452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggaagcgggcggucgutt

SEQ ID NO: 2453 - RNA, 19 nt, Artificial Sequence
  source: /note="Description of Artificial Sequence: Synthetic oligonucleotide"
cgcuucccccccuguucaa

SEQ ID NO: 2454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcuucccccccuguucaatt

SEQ ID NO: 2455 - RNA, 19 nt, Artificial Sequence
  source: /note="Description of Artificial Sequence: Synthetic oligonucleotide"
uugaacagggggggaagcg

SEQ ID NO: 2456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaacagggggggaagcgtt

SEQ ID NO: 2457 - RNA, 19 nt, Artificial Sequence
  source: /note="Description of Artificial Sequence: Synthetic oligonucleotide"
guccuggugaacuguccau

SEQ ID NO: 2458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuggugaacuguccautt

SEQ ID NO: 2459 - RNA, 19 nt, Artificial Sequence
  source: /note="Description of Artificial Sequence: Synthetic oligonucleotide"
auggacaguucaccaggac

SEQ ID NO: 2460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggacaguucaccaggactt

SEQ ID NO: 2461 - RNA, 19 nt, Artificial Sequence
  source: /note="Description of Artificial Sequence: Synthetic oligonucleotide"
ggugaacuguccauccaac

SEQ ID NO: 2462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugaacuguccauccaactt

SEQ ID NO: 2463 - RNA, 19 nt, Artificial Sequence
  source: /note="Description of Artificial Sequence: Synthetic oligonucleotide"
guuggauggacaguucacc

SEQ ID NO: 2464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuggauggacaguucacctt

SEQ ID NO: 2465 - RNA, 19 nt, Artificial Sequence
  source: /note="Description of Artificial Sequence: Synthetic oligonucleotide"
gugaacuguccauccaacc

SEQ ID NO: 2466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaacuguccauccaacctt

SEQ ID NO: 2467 - RNA, 19 nt, Artificial Sequence
  source: /note="Description of Artificial Sequence: Synthetic oligonucleotide"
gguuggauggacaguucac

SEQ ID NO: 2468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuggauggacaguucactt

SEQ ID NO: 2469 - RNA, 19 nt, Artificial Sequence
  source: /note="Description of Artificial Sequence: Synthetic oligonucleotide"
ccauccaaccaucucucaa

SEQ ID NO: 2470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauccaaccaucucucaatt

SEQ ID NO: 2471 - RNA, 19 nt, Artificial Sequence
  source: /note="Description of Artificial Sequence: Synthetic oligonucleotide"
uugagagaugguuggaugg

SEQ ID NO: 2472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugagagaugguuggauggtt

SEQ ID NO: 2473 - RNA, 19 nt, Artificial Sequence
  source: /note="Description of Artificial Sequence: Synthetic oligonucleotide"
cauccaaccaucucucaau

SEQ ID NO: 2474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccaaccaucucucaautt

SEQ ID NO: 2475 - RNA, 19 nt, Artificial Sequence
  source: /note="Description of Artificial Sequence: Synthetic oligonucleotide"
auugagagaugguuggaug

SEQ ID NO: 2476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugagagaugguuggaugtt

SEQ ID NO: 2477 - RNA, 19 nt, Artificial Sequence
  source: /note="Description of Artificial Sequence: Synthetic oligonucleotide"
caaccaucucucaaugcca

SEQ ID NO: 2478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaccaucucucaaugccatt

SEQ ID NO: 2479 - RNA, 19 nt, Artificial Sequence
  source: /note="Description of Artificial Sequence: Synthetic oligonucleotide"
uggcauugagagaugguug

SEQ ID NO: 2480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcauugagagaugguugtt

SEQ ID NO: 2481 - RNA, 19 nt, Artificial Sequence
  source: /note="Description of Artificial Sequence: Synthetic oligonucleotide"
aaccaucucucaaugccau

SEQ ID NO: 2482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccaucucucaaugccautt

SEQ ID NO: 2483 - RNA, 19 nt, Artificial Sequence
  source: /note="Description of Artificial Sequence: Synthetic oligonucleotide"
auggcauugagagaugguu

SEQ ID NO: 2484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcauugagagaugguutt

SEQ ID NO: 2485 - RNA, 19 nt, Artificial Sequence
  source: /note="Description of Artificial Sequence: Synthetic oligonucleotide"
accaucucucaaugccauu

SEQ ID NO: 2486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaucucucaaugccauutt

SEQ ID NO: 2487 - RNA, 19 nt, Artificial Sequence
  source: /note="Description of Artificial Sequence: Synthetic oligonucleotide"
aauggcauugagagauggu

SEQ ID NO: 2488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggcauugagagauggutt

SEQ ID NO: 2489 - RNA, 19 nt, Artificial Sequence
  source: /note="Description of Artificial Sequence: Synthetic oligonucleotide"
ucuccccucaccacuuccu

SEQ ID NO: 2490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccccucaccacuuccutt

SEQ ID NO: 2491 - RNA, 19 nt, Artificial Sequence
  source: /note="Description of Artificial Sequence: Synthetic oligonucleotide"
aggaaguggugaggggaga

SEQ ID NO: 2492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaaguggugaggggagatt

SEQ ID NO: 2493 - RNA, 19 nt, Artificial Sequence
  source: /note="Description of Artificial Sequence: Synthetic oligonucleotide"
uccccucaccacuuccuac

SEQ ID NO: 2494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccucaccacuuccuactt

SEQ ID NO: 2495 - RNA, 19 nt, Artificial Sequence
  source: /note="Description of Artificial Sequence: Synthetic oligonucleotide"
guaggaaguggugagggga

SEQ ID NO: 2496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggaaguggugaggggatt

SEQ ID NO: 2497 - RNA, 19 nt, Artificial Sequence
  source: /note="Description of Artificial Sequence: Synthetic oligonucleotide"
ccucaccacuuccuacaac

SEQ ID NO: 2498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaccacuuccuacaactt

SEQ ID NO: 2499 - RNA, 19 nt, Artificial Sequence
  source: /note="Description of Artificial Sequence: Synthetic oligonucleotide"
guuguaggaaguggugagg

SEQ ID NO: 2500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuguaggaaguggugaggtt

SEQ ID NO: 2501 - RNA, 19 nt, Artificial Sequence
  source: /note="Description of Artificial Sequence: Synthetic oligonucleotide"
accacuuccuacaacccau

SEQ ID NO: 2502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuuccuacaacccautt

SEQ ID NO: 2503 - RNA, 19 nt, Artificial Sequence
  source: /note="Description of Artificial Sequence: Synthetic oligonucleotide"
auggguuguaggaaguggu

SEQ ID NO: 2504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggguuguaggaaguggutt

SEQ ID NO: 2505 - RNA, 19 nt, Artificial Sequence
  source: /note="Description of Artificial Sequence: Synthetic oligonucleotide"
ccacuuccuacaacccauc

SEQ ID NO: 2506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuuccuacaacccauctt

SEQ ID NO: 2507 - RNA, 19 nt, Artificial Sequence
  source: /note="Description of Artificial Sequence: Synthetic oligonucleotide"
gauggguuguaggaagugg

SEQ ID NO: 2508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggguuguaggaaguggtt

SEQ ID NO: 2509 - RNA, 19 nt, Artificial Sequence
  source: /note="Description of Artificial Sequence: Synthetic oligonucleotide"
cacuuccuacaacccaucc

SEQ ID NO: 2510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuuccuacaacccaucctt

SEQ ID NO: 2511 - RNA, 19 nt, Artificial Sequence
  source: /note="Description of Artificial Sequence: Synthetic oligonucleotide"
ggauggguuguaggaagug

SEQ ID NO: 2512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauggguuguaggaagugtt

SEQ ID NO: 2513 - RNA, 19 nt, Artificial Sequence
  source: /note="Description of Artificial Sequence: Synthetic oligonucleotide"
cuuccuacaacccauccuc

SEQ ID NO: 2514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccuacaacccauccuctt

SEQ ID NO: 2515 - RNA, 19 nt, Artificial Sequence
  source: /note="Description of Artificial Sequence: Synthetic oligonucleotide"
gaggauggguuguaggaag

SEQ ID NO: 2516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggauggguuguaggaagtt

SEQ ID NO: 2517 - RNA, 19 nt, Artificial Sequence
  source: /note="Description of Artificial Sequence: Synthetic oligonucleotide"
uuccuacaacccauccuca

SEQ ID NO: 2518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuacaacccauccucatt

SEQ ID NO: 2519 - RNA, 19 nt, Artificial Sequence
  source: /note="Description of Artificial Sequence: Synthetic oligonucleotide"
ugaggauggguuguaggaa

SEQ ID NO: 2520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggauggguuguaggaatt

SEQ ID NO: 2521 - RNA, 19 nt, Artificial Sequence
  source: /note="Description of Artificial Sequence: Synthetic oligonucleotide"
cuacaacccauccucacaa

SEQ ID NO: 2522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaacccauccucacaatt

SEQ ID NO: 2523 - RNA, 19 nt, Artificial Sequence
  source: /note="Description of Artificial Sequence: Synthetic oligonucleotide"
uugugaggauggguuguag

SEQ ID NO: 2524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugugaggauggguuguagtt

SEQ ID NO: 2525 - RNA, 19 nt, Artificial Sequence
  source: /note="Description of Artificial Sequence: Synthetic oligonucleotide"
uacaacccauccucacaag

SEQ ID NO: 2526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaacccauccucacaagtt

SEQ ID NO: 2527 - RNA, 19 nt, Artificial Sequence
  source: /note="Description of Artificial Sequence: Synthetic oligonucleotide"
cuugugaggauggguugua

SEQ ID NO: 2528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugugaggauggguuguatt

SEQ ID NO: 2529 - RNA, 19 nt, Artificial Sequence
  source: /note="Description of Artificial Sequence: Synthetic oligonucleotide"
aacccauccucacaagcuu

SEQ ID NO: 2530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacccauccucacaagcuutt

SEQ ID NO: 2531 - RNA, 19 nt, Artificial Sequence
  source: /note="Description of Artificial Sequence: Synthetic oligonucleotide"
aagcuugugaggauggguu

SEQ ID NO: 2532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuugugaggauggguutt

SEQ ID NO: 2533 - RNA, 19 nt, Artificial Sequence
  source: /note="Description of Artificial Sequence: Synthetic oligonucleotide"
acccauccucacaagcuuu

SEQ ID NO: 2534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccauccucacaagcuuutt

SEQ ID NO: 2535 - RNA, 19 nt, Artificial Sequence
  source: /note="Description of Artificial Sequence: Synthetic oligonucleotide"
aaagcuugugaggaugggu

SEQ ID NO: 2536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcuugugaggaugggutt

SEQ ID NO: 2537 - RNA, 19 nt, Artificial Sequence
  source: /note="Description of Artificial Sequence: Synthetic oligonucleotide"
uuaacugaagcucagacug

SEQ ID NO: 2538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaacugaagcucagacugtt

SEQ ID NO: 2539 - RNA, 19 nt, Artificial Sequence
  source: /note="Description of Artificial Sequence: Synthetic oligonucleotide"
cagucugagcuucaguuaa

SEQ ID NO: 2540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagucugagcuucaguuaatt

SEQ ID NO: 2541 - RNA, 19 nt, Artificial Sequence
  source: /note="Description of Artificial Sequence: Synthetic oligonucleotide"
uaacugaagcucagacugg

SEQ ID NO: 2542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacugaagcucagacuggtt

SEQ ID NO: 2543 - RNA, 19 nt, Artificial Sequence
  source: /note="Description of Artificial Sequence: Synthetic oligonucleotide"
ccagucugagcuucaguua

SEQ ID NO: 2544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagucugagcuucaguuatt

SEQ ID NO: 2545 - RNA, 19 nt, Artificial Sequence
  source: /note="Description of Artificial Sequence: Synthetic oligonucleotide"
aacugaagcucagacuggc

SEQ ID NO: 2546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugaagcucagacuggctt

SEQ ID NO: 2547 - RNA, 19 nt, Artificial Sequence
  source: /note="Description of Artificial Sequence: Synthetic oligonucleotide"
gccagucugagcuucaguu

SEQ ID NO: 2548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagucugagcuucaguutt

SEQ ID NO: 2549 - RNA, 19 nt, Artificial Sequence
  source: /note="Description of Artificial Sequence: Synthetic oligonucleotide"
acugaagcucagacuggcc

SEQ ID NO: 2550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugaagcucagacuggcctt

SEQ ID NO: 2551 - RNA, 19 nt, Artificial Sequence
  source: /note="Description of Artificial Sequence: Synthetic oligonucleotide"
ggccagucugagcuucagu

SEQ ID NO: 2552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccagucugagcuucagutt

SEQ ID NO: 2553 - RNA, 19 nt, Artificial Sequence
  source: /note="Description of Artificial Sequence: Synthetic oligonucleotide"
ugaagcucagacuggccaa

SEQ ID NO: 2554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaagcucagacuggccaatt

SEQ ID NO: 2555 - RNA, 19 nt, Artificial Sequence
  source: /note="Description of Artificial Sequence: Synthetic oligonucleotide"
uuggccagucugagcuuca

SEQ ID NO: 2556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggccagucugagcuucatt

SEQ ID NO: 2557 - RNA, 19 nt, Artificial Sequence
  source: /note="Description of Artificial Sequence: Synthetic oligonucleotide"
ucagacuggccaagauugg

SEQ ID NO: 2558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagacuggccaagauuggtt

SEQ ID NO: 2559 - RNA, 19 nt, Artificial Sequence
  source: /note="Description of Artificial Sequence: Synthetic oligonucleotide"
ccaaucuuggccagucuga

SEQ ID NO: 2560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaucuuggccagucugatt

SEQ ID NO: 2561 - RNA, 19 nt, Artificial Sequence
  source: /note="Description of Artificial Sequence: Synthetic oligonucleotide"
cuggccaagauuggcagcc

SEQ ID NO: 2562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggccaagauuggcagcctt

SEQ ID NO: 2563 - RNA, 19 nt, Artificial Sequence
  source: /note="Description of Artificial Sequence: Synthetic oligonucleotide"
ggcugccaaucuuggccag

SEQ ID NO: 2564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugccaaucuuggccagtt

SEQ ID NO: 2565 - RNA, 19 nt, Artificial Sequence
  source: /note="Description of Artificial Sequence: Synthetic oligonucleotide"
ccaagauuggcagccaucu

SEQ ID NO: 2566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagauuggcagccaucutt

SEQ ID NO: 2567 - RNA, 19 nt, Artificial Sequence
  source: /note="Description of Artificial Sequence: Synthetic oligonucleotide"
agauggcugccaaucuugg

SEQ ID NO: 2568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauggcugccaaucuuggtt

SEQ ID NO: 2569 - RNA, 19 nt, Artificial Sequence
  source: /note="Description of Artificial Sequence: Synthetic oligonucleotide"
gauuggcagccaucugaug

SEQ ID NO: 2570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuggcagccaucugaugtt

SEQ ID NO: 2571 - RNA, 19 nt, Artificial Sequence
  source: /note="Description of Artificial Sequence: Synthetic oligonucleotide"
caucagauggcugccaauc

SEQ ID NO: 2572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucagauggcugccaauctt

SEQ ID NO: 2573 - RNA, 19 nt, Artificial Sequence
  source: /note="Description of Artificial Sequence: Synthetic oligonucleotide"
gcuagcucuuccugagggc

SEQ ID NO: 2574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagcucuuccugagggctt

SEQ ID NO: 2575 - RNA, 19 nt, Artificial Sequence
  source: /note="Description of Artificial Sequence: Synthetic oligonucleotide"
gcccucaggaagagcuagc

SEQ ID NO: 2576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccucaggaagagcuagctt

SEQ ID NO: 2577 - RNA, 19 nt, Artificial Sequence
  source: /note="Description of Artificial Sequence: Synthetic oligonucleotide"
gcucuuccugagggcccca

SEQ ID NO: 2578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuuccugagggccccatt

SEQ ID NO: 2579 - RNA, 19 nt, Artificial Sequence
  source: /note="Description of Artificial Sequence: Synthetic oligonucleotide"
uggggcccucaggaagagc

SEQ ID NO: 2580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggcccucaggaagagctt

SEQ ID NO: 2581 - RNA, 19 nt, Artificial Sequence
  source: /note="Description of Artificial Sequence: Synthetic oligonucleotide"
cuuccugagggccccaccg

SEQ ID NO: 2582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccugagggccccaccgtt

SEQ ID NO: 2583 - RNA, 19 nt, Artificial Sequence
  source: /note="Description of Artificial Sequence: Synthetic oligonucleotide"
cgguggggcccucaggaag

SEQ ID NO: 2584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguggggcccucaggaagtt

SEQ ID NO: 2585 - RNA, 19 nt, Artificial Sequence
  source: /note="Description of Artificial Sequence: Synthetic oligonucleotide"
caucuaggccucccucagc

SEQ ID NO: 2586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuaggccucccucagctt

SEQ ID NO: 2587 - RNA, 19 nt, Artificial Sequence
  source: /note="Description of Artificial Sequence: Synthetic oligonucleotide"
gcugagggaggccuagaug

SEQ ID NO: 2588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugagggaggccuagaugtt

SEQ ID NO: 2589 - RNA, 19 nt, Artificial Sequence
  source: /note="Description of Artificial Sequence: Synthetic oligonucleotide"
ucuaggccucccucagcag

SEQ ID NO: 2590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuaggccucccucagcagtt

SEQ ID NO: 2591 - RNA, 19 nt, Artificial Sequence
  source: /note="Description of Artificial Sequence: Synthetic oligonucleotide"
cugcugagggaggccuaga

SEQ ID NO: 2592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcugagggaggccuagatt

SEQ ID NO: 2593 - RNA, 19 nt, Artificial Sequence
  source: /note="Description of Artificial Sequence: Synthetic oligonucleotide"
uuuuuaaagaggauuuuaa

SEQ ID NO: 2594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuuaaagaggauuuuaatt

SEQ ID NO: 2595 - RNA, 19 nt, Artificial Sequence
  source: /note="Description of Artificial Sequence: Synthetic oligonucleotide"
uuaaaauccucuuuaaaaa

SEQ ID NO: 2596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaauccucuuuaaaaatt

SEQ ID NO: 2597 - RNA, 19 nt, Artificial Sequence
  source: /note="Description of Artificial Sequence: Synthetic oligonucleotide"
uuuuaaagaggauuuuaac

SEQ ID NO: 2598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuaaagaggauuuuaactt

SEQ ID NO: 2599 - RNA, 19 nt, Artificial Sequence
  source: /note="Description of Artificial Sequence: Synthetic oligonucleotide"
guuaaaauccucuuuaaaa

SEQ ID NO: 2600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaaaauccucuuuaaaatt

SEQ ID NO: 2601 - RNA, 19 nt, Artificial Sequence
  source: /note="Description of Artificial Sequence: Synthetic oligonucleotide"
uuuaaagaggauuuuaacu

SEQ ID NO: 2602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaaagaggauuuuaacutt

SEQ ID NO: 2603 - RNA, 19 nt, Artificial Sequence
  source: /note="Description of Artificial Sequence: Synthetic oligonucleotide"
aguuaaaauccucuuuaaa

SEQ ID NO: 2604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuaaaauccucuuuaaatt

SEQ ID NO: 2605 - RNA, 19 nt, Artificial Sequence
  source: /note="Description of Artificial Sequence: Synthetic oligonucleotide"
uuaaagaggauuuuaacug

SEQ ID NO: 2606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaagaggauuuuaacugtt

SEQ ID NO: 2607 - RNA, 19 nt, Artificial Sequence
  source: /note="Description of Artificial Sequence: Synthetic oligonucleotide"
caguuaaaauccucuuuaa

SEQ ID NO: 2608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguuaaaauccucuuuaatt

SEQ ID NO: 2609 - RNA, 19 nt, Artificial Sequence
  source: /note="Description of Artificial Sequence: Synthetic oligonucleotide"
uaaagaggauuuuaacugu

SEQ ID NO: 2610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaagaggauuuuaacugutt

SEQ ID NO: 2611 - RNA, 19 nt, Artificial Sequence
  source: /note="Description of Artificial Sequence: Synthetic oligonucleotide"
acaguuaaaauccucuuua

SEQ ID NO: 2612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguuaaaauccucuuuatt

SEQ ID NO: 2613 - RNA, 19 nt, Artificial Sequence
  source: /note="Description of Artificial Sequence: Synthetic oligonucleotide"
aagaggauuuuaacuguuu

SEQ ID NO: 2614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaggauuuuaacuguuutt

SEQ ID NO: 2615 - RNA, 19 nt, Artificial Sequence
  source: /note="Description of Artificial Sequence: Synthetic oligonucleotide"
aaacaguuaaaauccucuu

SEQ ID NO: 2616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacaguuaaaauccucuutt

SEQ ID NO: 2617 - RNA, 19 nt, Artificial Sequence
  source: /note="Description of Artificial Sequence: Synthetic oligonucleotide"
ggauuuuaacuguuuguag

SEQ ID NO: 2618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauuuuaacuguuuguagtt

SEQ ID NO: 2619 - RNA, 19 nt, Artificial Sequence
  source: /note="Description of Artificial Sequence: Synthetic oligonucleotide"
cuacaaacaguuaaaaucc

SEQ ID NO: 2620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaaacaguuaaaaucctt

SEQ ID NO: 2621 - RNA, 19 nt, Artificial Sequence
  source: /note="Description of Artificial Sequence: Synthetic oligonucleotide"
cuguuuguaggggagggga

SEQ ID NO: 2622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguuuguaggggaggggatt

SEQ ID NO: 2623 - RNA, 19 nt, Artificial Sequence
  source: /note="Description of Artificial Sequence: Synthetic oligonucleotide"
uccccuccccuacaaacag

SEQ ID NO: 2624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccuccccuacaaacagtt

SEQ ID NO: 2625 - RNA, 19 nt, Artificial Sequence
  source: /note="Description of Artificial Sequence: Synthetic oligonucleotide"
uguuuguaggggaggggag

SEQ ID NO: 2626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuuguaggggaggggagtt

SEQ ID NO: 2627 - RNA, 19 nt, Artificial Sequence
  source: /note="Description of Artificial Sequence: Synthetic oligonucleotide"
cuccccuccccuacaaaca

SEQ ID NO: 2628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccuccccuacaaacatt

SEQ ID NO: 2629 - RNA, 19 nt, Artificial Sequence
  source: /note="Description of Artificial Sequence: Synthetic oligonucleotide"
uuguaggggaggggagaaa

SEQ ID NO: 2630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguaggggaggggagaaatt

SEQ ID NO: 2631 - RNA, 19 nt, Artificial Sequence
  source: /note="Description of Artificial Sequence: Synthetic oligonucleotide"
uuucuccccuccccuacaa

SEQ ID NO: 2632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuccccuccccuacaatt

SEQ ID NO: 2633 - RNA, 19 nt, Artificial Sequence
  source: /note="Description of Artificial Sequence: Synthetic oligonucleotide"
uguaggggaggggagaaaa

SEQ ID NO: 2634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaggggaggggagaaaatt

SEQ ID NO: 2635 - RNA, 19 nt, Artificial Sequence
  source: /note="Description of Artificial Sequence: Synthetic oligonucleotide"
uuuucuccccuccccuaca

SEQ ID NO: 2636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuucuccccuccccuacatt

SEQ ID NO: 2637 - RNA, 19 nt, Artificial Sequence
  source: /note="Description of Artificial Sequence: Synthetic oligonucleotide"
ggagaaaaggaaggacggg

SEQ ID NO: 2638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaaaaggaaggacgggtt

SEQ ID NO: 2639 - RNA, 19 nt, Artificial Sequence
  source: /note="Description of Artificial Sequence: Synthetic oligonucleotide"
cccguccuuccuuuucucc

SEQ ID NO: 2640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccguccuuccuuuucucctt

SEQ ID NO: 2641 - RNA, 19 nt, Artificial Sequence
  source: /note="Description of Artificial Sequence: Synthetic oligonucleotide"
gagaaaaggaaggacgggg

SEQ ID NO: 2642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaaaaggaaggacggggtt

SEQ ID NO: 2643 - RNA, 19 nt, Artificial Sequence
  source: /note="Description of Artificial Sequence: Synthetic oligonucleotide"
ccccguccuuccuuuucuc

SEQ ID NO: 2644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccguccuuccuuuucuctt

SEQ ID NO: 2645 - RNA, 19 nt, Artificial Sequence
  source: /note="Description of Artificial Sequence: Synthetic oligonucleotide"
agaaaaggaaggacggggu

SEQ ID NO: 2646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaaggaaggacggggutt

SEQ ID NO: 2647 - RNA, 19 nt, Artificial Sequence
  source: /note="Description of Artificial Sequence: Synthetic oligonucleotide"
accccguccuuccuuuucu

SEQ ID NO: 2648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accccguccuuccuuuucutt

SEQ ID NO: 2649 - RNA, 19 nt, Artificial Sequence
  source: /note="Description of Artificial Sequence: Synthetic oligonucleotide"
aaaaggaaggacgggguuu

SEQ ID NO: 2650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaggaaggacgggguuutt

SEQ ID NO: 2651 - RNA, 19 nt, Artificial Sequence
  source: /note="Description of Artificial Sequence: Synthetic oligonucleotide"
aaaccccguccuuccuuuu

SEQ ID NO: 2652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaccccguccuuccuuuutt

SEQ ID NO: 2653 - RNA, 19 nt, Artificial Sequence
  source: /note="Description of Artificial Sequence: Synthetic oligonucleotide"
ggggugugaggaccuucua

SEQ ID NO: 2654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggugugaggaccuucuatt

SEQ ID NO: 2655 - RNA, 19 nt, Artificial Sequence
  source: /note="Description of Artificial Sequence: Synthetic oligonucleotide"
uagaagguccucacacccc

SEQ ID NO: 2656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaagguccucacacccctt

SEQ ID NO: 2657 - RNA, 19 nt, Artificial Sequence
  source: /note="Description of Artificial Sequence: Synthetic oligonucleotide"
gggugugaggaccuucuac

SEQ ID NO: 2658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggugugaggaccuucuactt

SEQ ID NO: 2659 - RNA, 19 nt, Artificial Sequence
  source: /note="Description of Artificial Sequence: Synthetic oligonucleotide"
guagaagguccucacaccc

SEQ ID NO: 2660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaagguccucacaccctt

SEQ ID NO: 2661 - RNA, 19 nt, Artificial Sequence
  source: /note="Description of Artificial Sequence: Synthetic oligonucleotide"
ggugugaggaccuucuacc

SEQ ID NO: 2662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugugaggaccuucuacctt

SEQ ID NO: 2663 - RNA, 19 nt, Artificial Sequence
  source: /note="Description of Artificial Sequence: Synthetic oligonucleotide"
gguagaagguccucacacc

SEQ ID NO: 2664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagaagguccucacacctt

SEQ ID NO: 2665 - RNA, 19 nt, Artificial Sequence
  source: /note="Description of Artificial Sequence: Synthetic oligonucleotide"
ugugaggaccuucuacccc

SEQ ID NO: 2666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugaggaccuucuacccctt

SEQ ID NO: 2667 - RNA, 19 nt, Artificial Sequence
  source: /note="Description of Artificial Sequence: Synthetic oligonucleotide"
gggguagaagguccucaca

SEQ ID NO: 2668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguagaagguccucacatt

SEQ ID NO: 2669 - RNA, 19 nt, Artificial Sequence
  source: /note="Description of Artificial Sequence: Synthetic oligonucleotide"
gugaggaccuucuaccccc

SEQ ID NO: 2670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaggaccuucuaccccctt

SEQ ID NO: 2671 - RNA, 19 nt, Artificial Sequence
  source: /note="Description of Artificial Sequence: Synthetic oligonucleotide"
ggggguagaagguccucac

SEQ ID NO: 2672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggguagaagguccucactt

SEQ ID NO: 2673 - RNA, 19 nt, Artificial Sequence
  source: /note="Description of Artificial Sequence: Synthetic oligonucleotide"
cucccccccucucccaggu

SEQ ID NO: 2674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccccccucucccaggutt

SEQ ID NO: 2675 - RNA, 19 nt, Artificial Sequence
  source: /note="Description of Artificial Sequence: Synthetic oligonucleotide"
accugggagagggggggag

SEQ ID NO: 2676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accugggagagggggggagtt

SEQ ID NO: 2677 - RNA, 19 nt, Artificial Sequence
  source: /note="Description of Artificial Sequence: Synthetic oligonucleotide"
ccccucucccaggucccuu

SEQ ID NO: 2678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccucucccaggucccuutt

SEQ ID NO: 2679 - RNA, 19 nt, Artificial Sequence
  source: /note="Description of Artificial Sequence: Synthetic oligonucleotide"
aagggaccugggagagggg

SEQ ID NO: 2680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggaccugggagaggggtt

SEQ ID NO: 2681 - RNA, 19 nt, Artificial Sequence
  source: /note="Description of Artificial Sequence: Synthetic oligonucleotide"
ucccaggucccuuguaaau

SEQ ID NO: 2682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccaggucccuuguaaautt

SEQ ID NO: 2683 - RNA, 19 nt, Artificial Sequence
  source: /note="Description of Artificial Sequence: Synthetic oligonucleotide"
auuuacaagggaccuggga

SEQ ID NO: 2684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuacaagggaccugggatt

SEQ ID NO: 2685 - RNA, 19 nt, Artificial Sequence
  source: /note="Description of Artificial Sequence: Synthetic oligonucleotide"
aggucccuuguaaauagaa

SEQ ID NO: 2686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggucccuuguaaauagaatt

SEQ ID NO: 2687 - RNA, 19 nt, Artificial Sequence
  source: /note="Description of Artificial Sequence: Synthetic oligonucleotide"
uucuauuuacaagggaccu

SEQ ID NO: 2688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuauuuacaagggaccutt

SEQ ID NO: 2689 - RNA, 19 nt, Artificial Sequence
  source: /note="Description of Artificial Sequence: Synthetic oligonucleotide"
guaaauagaaccagcccag

SEQ ID NO: 2690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaauagaaccagcccagtt

SEQ ID NO: 2691 - RNA, 19 nt, Artificial Sequence
  source: /note="Description of Artificial Sequence: Synthetic oligonucleotide"
cugggcugguucuauuuac

SEQ ID NO: 2692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggcugguucuauuuactt

SEQ ID NO: 2693 - RNA, 19 nt, Artificial Sequence
  source: /note="Description of Artificial Sequence: Synthetic oligonucleotide"
uaaauagaaccagcccagc

SEQ ID NO: 2694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaauagaaccagcccagctt

SEQ ID NO: 2695 - RNA, 19 nt, Artificial Sequence
  source: /note="Description of Artificial Sequence: Synthetic oligonucleotide"
gcugggcugguucuauuua

SEQ ID NO: 2696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggcugguucuauuuatt

SEQ ID NO: 2697 - RNA, 19 nt, Artificial Sequence
  source: /note="Description of Artificial Sequence: Synthetic oligonucleotide"
cagcccagcccaucucucg

SEQ ID NO: 2698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccagcccaucucucgtt

SEQ ID NO: 2699 - RNA, 19 nt, Artificial Sequence
  source: /note="Description of Artificial Sequence: Synthetic oligonucleotide"
cgagagaugggcugggcug

SEQ ID NO: 2700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagagaugggcugggcugtt

SEQ ID NO: 2701 - RNA, 19 nt, Artificial Sequence
  source: /note="Description of Artificial Sequence: Synthetic oligonucleotide"
agcccagcccaucucucgu

SEQ ID NO: 2702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccagcccaucucucgutt

SEQ ID NO: 2703 - RNA, 19 nt, Artificial Sequence
  source: /note="Description of Artificial Sequence: Synthetic oligonucleotide"
acgagagaugggcugggcu

SEQ ID NO: 2704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgagagaugggcugggcutt

SEQ ID NO: 2705 - RNA, 19 nt, Artificial Sequence
  source: /note="Description of Artificial Sequence: Synthetic oligonucleotide"
gcccagcccaucucucguc

SEQ ID NO: 2706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagcccaucucucguctt

SEQ ID NO: 2707 - RNA, 19 nt, Artificial Sequence
  source: /note="Description of Artificial Sequence: Synthetic oligonucleotide"
gacgagagaugggcugggc

SEQ ID NO: 2708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgagagaugggcugggctt

SEQ ID NO: 2709 - RNA, 19 nt, Artificial Sequence
  source: /note="Description of Artificial Sequence: Synthetic oligonucleotide"
ccagcccaucucucgucuu

SEQ ID NO: 2710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcccaucucucgucuutt

SEQ ID NO: 2711 - RNA, 19 nt, Artificial Sequence
  source: /note="Description of Artificial Sequence: Synthetic oligonucleotide"
aagacgagagaugggcugg

SEQ ID NO: 2712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagacgagagaugggcuggtt

SEQ ID NO: 2713 - RNA, 19 nt, Artificial Sequence
  source: /note="Description of Artificial Sequence: Synthetic oligonucleotide"
ucccuucccuggcccccug

SEQ ID NO: 2714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuucccuggcccccugtt

SEQ ID NO: 2715 - RNA, 19 nt, Artificial Sequence
  source: /note="Description of Artificial Sequence: Synthetic oligonucleotide"
cagggggccagggaaggga

SEQ ID NO: 2716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggggccagggaagggatt

SEQ ID NO: 2717 - RNA, 19 nt, Artificial Sequence
  source: /note="Description of Artificial Sequence: Synthetic oligonucleotide"
cccuggcccccugggugua

SEQ ID NO: 2718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggcccccuggguguatt

SEQ ID NO: 2719 - RNA, 19 nt, Artificial Sequence
  source: /note="Description of Artificial Sequence: Synthetic oligonucleotide"
uacacccagggggccaggg

SEQ ID NO: 2720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacccagggggccagggtt

SEQ ID NO: 2721 - RNA, 19 nt, Artificial Sequence
  source: /note="Description of Artificial Sequence: Synthetic oligonucleotide"
uggcccccuggguguaaau

SEQ ID NO: 2722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcccccuggguguaaautt

SEQ ID NO: 2723 - RNA, 19 nt, Artificial Sequence
  source: /note="Description of Artificial Sequence: Synthetic oligonucleotide"
auuuacacccagggggcca

SEQ ID NO: 2724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuacacccagggggccatt

SEQ ID NO: 2725 - RNA, 19 nt, Artificial Sequence
  source: /note="Description of Artificial Sequence: Synthetic oligonucleotide"
ggcccccuggguguaaaua

SEQ ID NO: 2726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccccuggguguaaauatt

SEQ ID NO: 2727 - RNA, 19 nt, Artificial Sequence
  source: /note="Description of Artificial Sequence: Synthetic oligonucleotide"
uauuuacacccagggggcc

SEQ ID NO: 2728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuuacacccagggggcctt

SEQ ID NO: 2729 - RNA, 19 nt, Artificial Sequence
  source: /note="Description of Artificial Sequence: Synthetic oligonucleotide"
gguguaaauagauuguuau

SEQ ID NO: 2730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguaaauagauuguuautt

SEQ ID NO: 2731 - RNA, 19 nt, Artificial Sequence
  source: /note="Description of Artificial Sequence: Synthetic oligonucleotide"
auaacaaucuauuuacacc

SEQ ID NO: 2732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaacaaucuauuuacacctt

SEQ ID NO: 2733 - RNA, 19 nt, Artificial Sequence
  source: /note="Description of Artificial Sequence: Synthetic oligonucleotide"
aauagauuguuauaauuuu

SEQ ID NO: 2734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauagauuguuauaauuuutt

SEQ ID NO: 2735 - RNA, 19 nt, Artificial Sequence
  source: /note="Description of Artificial Sequence: Synthetic oligonucleotide"
aaaauuauaacaaucuauu

SEQ ID NO: 2736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaauuauaacaaucuauutt

SEQ ID NO: 2737 - RNA, 19 nt, Artificial Sequence
  source: /note="Description of Artificial Sequence: Synthetic oligonucleotide"
uuguuauaauuuuuucuua

SEQ ID NO: 2738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguuauaauuuuuucuuatt

SEQ ID NO: 2739 - RNA, 19 nt, Artificial Sequence
  source: /note="Description of Artificial Sequence: Synthetic oligonucleotide"
uaagaaaaaauuauaacaa

SEQ ID NO: 2740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagaaaaaauuauaacaatt

SEQ ID NO: 2741 - RNA, 19 nt, Artificial Sequence
  source: /note="Description of Artificial Sequence: Synthetic oligonucleotide"
uuuuucuuaaagaaaacgu

SEQ ID NO: 2742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuucuuaaagaaaacgutt

SEQ ID NO: 2743 - RNA, 19 nt, Artificial Sequence
  source: /note="Description of Artificial Sequence: Synthetic oligonucleotide"
acguuuucuuuaagaaaaa

SEQ ID NO: 2744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acguuuucuuuaagaaaaatt

SEQ ID NO: 2745 - RNA, 19 nt, Artificial Sequence
  source: /note="Description of Artificial Sequence: Synthetic oligonucleotide"
uuuucuuaaagaaaacguc

SEQ ID NO: 2746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuucuuaaagaaaacguctt

SEQ ID NO: 2747 - RNA, 19 nt, Artificial Sequence
  source: /note="Description of Artificial Sequence: Synthetic oligonucleotide"
gacguuuucuuuaagaaaa

SEQ ID NO: 2748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacguuuucuuuaagaaaatt

SEQ ID NO: 2749 - RNA, 19 nt, Artificial Sequence
  source: /note="Description of Artificial Sequence: Synthetic oligonucleotide"
uucuuaaagaaaacgucaa

SEQ ID NO: 2750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuuaaagaaaacgucaatt

SEQ ID NO: 2751 - RNA, 19 nt, Artificial Sequence
  source: /note="Description of Artificial Sequence: Synthetic oligonucleotide"
uugacguuuucuuuaagaa

SEQ ID NO: 2752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugacguuuucuuuaagaatt

SEQ ID NO: 2753 - RNA, 19 nt, Artificial Sequence
  source: /note="Description of Artificial Sequence: Synthetic oligonucleotide"
aagaaaacgucaauucaca

SEQ ID NO: 2754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaaacgucaauucacatt

SEQ ID NO: 2755 - RNA, 19 nt, Artificial Sequence
  source: /note="Description of Artificial Sequence: Synthetic oligonucleotide"
ugugaauugacguuuucuu

SEQ ID NO: 2756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugaauugacguuuucuutt

SEQ ID NO: 2757 - RNA, 19 nt, Artificial Sequence
  source: /note="Description of Artificial Sequence: Synthetic oligonucleotide"
ucaauucacaccauucaac

SEQ ID NO: 2758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaauucacaccauucaactt

SEQ ID NO: 2759 - RNA, 19 nt, Artificial Sequence
  source: /note="Description of Artificial Sequence: Synthetic oligonucleotide"
guugaauggugugaauuga

SEQ ID NO: 2760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugaauggugugaauugatt

SEQ ID NO: 2761 - RNA, 19 nt, Artificial Sequence
  source: /note="Description of Artificial Sequence: Synthetic oligonucleotide"
aauucacaccauucaacuu

SEQ ID NO: 2762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucacaccauucaacuutt

SEQ ID NO: 2763 - RNA, 19 nt, Artificial Sequence
  source: /note="Description of Artificial Sequence: Synthetic oligonucleotide"
aaguugaauggugugaauu

SEQ ID NO: 2764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguugaauggugugaauutt

SEQ ID NO: 2765 - RNA, 19 nt, Artificial Sequence
  source: /note="Description of Artificial Sequence: Synthetic oligonucleotide"
uucacaccauucaacuugc

SEQ ID NO: 2766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucacaccauucaacuugctt

SEQ ID NO: 2767 - RNA, 19 nt, Artificial Sequence
  source: /note="Description of Artificial Sequence: Synthetic oligonucleotide"
gcaaguugaauggugugaa

SEQ ID NO: 2768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaguugaauggugugaatt

SEQ ID NO: 2769 - RNA, 19 nt, Artificial Sequence
  source: /note="Description of Artificial Sequence: Synthetic oligonucleotide"
cacaccauucaacuugccc

SEQ ID NO: 2770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaccauucaacuugccctt

SEQ ID NO: 2771 - RNA, 19 nt, Artificial Sequence
  source: /note="Description of Artificial Sequence: Synthetic oligonucleotide"
gggcaaguugaauggugug

SEQ ID NO: 2772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcaaguugaauggugugtt

SEQ ID NO: 2773 - RNA, 19 nt, Artificial Sequence
  source: /note="Description of Artificial Sequence: Synthetic oligonucleotide"
aacuugccccccccagcug

SEQ ID NO: 2774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuugccccccccagcugtt

SEQ ID NO: 2775 - RNA, 19 nt, Artificial Sequence
  source: /note="Description of Artificial Sequence: Synthetic oligonucleotide"
cagcuggggggggcaaguu

SEQ ID NO: 2776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuggggggggcaaguutt

SEQ ID NO: 2777 - RNA, 19 nt, Artificial Sequence
  source: /note="Description of Artificial Sequence: Synthetic oligonucleotide"
acuugccccccccagcugu

SEQ ID NO: 2778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugccccccccagcugutt

SEQ ID NO: 2779 - RNA, 19 nt, Artificial Sequence
  source: /note="Description of Artificial Sequence: Synthetic oligonucleotide"
acagcuggggggggcaagu

SEQ ID NO: 2780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcuggggggggcaagutt

SEQ ID NO: 2781 - RNA, 19 nt, Artificial Sequence
  source: /note="Description of Artificial Sequence: Synthetic oligonucleotide"
gccccccccagcuguaccc

SEQ ID NO: 2782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccccccagcuguaccctt

SEQ ID NO: 2783 - RNA, 19 nt, Artificial Sequence
  source: /note="Description of Artificial Sequence: Synthetic oligonucleotide"
ggguacagcuggggggggc

SEQ ID NO: 2784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguacagcuggggggggctt

SEQ ID NO: 2785 - RNA, 19 nt, Artificial Sequence
  source: /note="Description of Artificial Sequence: Synthetic oligonucleotide"
ccccccccagcuguacccc

SEQ ID NO: 2786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccccccagcuguacccctt

SEQ ID NO: 2787 - RNA, 19 nt, Artificial Sequence
  source: /note="Description of Artificial Sequence: Synthetic oligonucleotide"
gggguacagcugggggggg

SEQ ID NO: 2788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguacagcuggggggggtt

SEQ ID NO: 2789 - RNA, 19 nt, Artificial Sequence
  source: /note="Description of Artificial Sequence: Synthetic oligonucleotide"
cccccccagcuguaccccu

SEQ ID NO: 2790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccccagcuguaccccutt

SEQ ID NO: 2791 - RNA, 19 nt, Artificial Sequence
  source: /note="Description of Artificial Sequence: Synthetic oligonucleotide"
agggguacagcuggggggg

SEQ ID NO: 2792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggguacagcugggggggtt

SEQ ID NO: 2793 - RNA, 19 nt, Artificial Sequence
  source: /note="Description of Artificial Sequence: Synthetic oligonucleotide"
ccccccagcuguaccccuu

SEQ ID NO: 2794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccccagcuguaccccuutt

SEQ ID NO: 2795 - RNA, 19 nt, Artificial Sequence
  source: /note="Description of Artificial Sequence: Synthetic oligonucleotide"
aagggguacagcugggggg

SEQ ID NO: 2796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggguacagcuggggggtt

SEQ ID NO: 2797 - RNA, 19 nt, Artificial Sequence
  source: /note="Description of Artificial Sequence: Synthetic oligonucleotide"
cccccagcuguaccccuuc

SEQ ID NO: 2798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccagcuguaccccuuctt

SEQ ID NO: 2799 - RNA, 19 nt, Artificial Sequence
  source: /note="Description of Artificial Sequence: Synthetic oligonucleotide"
gaagggguacagcuggggg

SEQ ID NO: 2800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagggguacagcugggggtt

SEQ ID NO: 2801 - RNA, 19 nt, Artificial Sequence
  source: /note="Description of Artificial Sequence: Synthetic oligonucleotide"
cuguaccccuucuuguccu

SEQ ID NO: 2802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaccccuucuuguccutt

SEQ ID NO: 2803 - RNA, 19 nt, Artificial Sequence
  source: /note="Description of Artificial Sequence: Synthetic oligonucleotide"
aggacaagaagggguacag

SEQ ID NO: 2804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacaagaagggguacagtt

SEQ ID NO: 2805 - RNA, 19 nt, Artificial Sequence
  source: /note="Description of Artificial Sequence: Synthetic oligonucleotide"
uguaccccuucuuguccuc

SEQ ID NO: 2806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaccccuucuuguccuctt

SEQ ID NO: 2807 - RNA, 19 nt, Artificial Sequence
  source: /note="Description of Artificial Sequence: Synthetic oligonucleotide"
gaggacaagaagggguaca

SEQ ID NO: 2808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggacaagaagggguacatt

SEQ ID NO: 2809 - RNA, 19 nt, Artificial Sequence
  source: /note="Description of Artificial Sequence: Synthetic oligonucleotide"
ccucugcucccaaggcuuc

SEQ ID NO: 2810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucugcucccaaggcuuctt

SEQ ID NO: 2811 - RNA, 19 nt, Artificial Sequence
  source: /note="Description of Artificial Sequence: Synthetic oligonucleotide"
gaagccuugggagcagagg

SEQ ID NO: 2812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagccuugggagcagaggtt

SEQ ID NO: 2813 - RNA, 19 nt, Artificial Sequence
  source: /note="Description of Artificial Sequence: Synthetic oligonucleotide"
cucugcucccaaggcuucc

SEQ ID NO: 2814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugcucccaaggcuucctt

SEQ ID NO: 2815 - RNA, 19 nt, Artificial Sequence
  source: /note="Description of Artificial Sequence: Synthetic oligonucleotide"
ggaagccuugggagcagag

SEQ ID NO: 2816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagccuugggagcagagtt

SEQ ID NO: 2817 - RNA, 19 nt, Artificial Sequence
  source: /note="Description of Artificial Sequence: Synthetic oligonucleotide"
cccauccuggaaggagggg

SEQ ID NO: 2818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccauccuggaaggaggggtt

SEQ ID NO: 2819 - RNA, 19 nt, Artificial Sequence
  source: /note="Description of Artificial Sequence: Synthetic oligonucleotide"
ccccuccuuccaggauggg

SEQ ID NO: 2820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuccuuccaggaugggtt

SEQ ID NO: 2821 - RNA, 19 nt, Artificial Sequence
  source: /note="Description of Artificial Sequence: Synthetic oligonucleotide"
cuggaaggaggggaguaga

SEQ ID NO: 2822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaaggaggggaguagatt

SEQ ID NO: 2823 - RNA, 19 nt, Artificial Sequence
  source: /note="Description of Artificial Sequence: Synthetic oligonucleotide"
ucuacuccccuccuuccag

SEQ ID NO: 2824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacuccccuccuuccagtt

SEQ ID NO: 2825 - RNA, 19 nt, Artificial Sequence
  source: /note="Description of Artificial Sequence: Synthetic oligonucleotide"
uggaaggaggggaguagag

SEQ ID NO: 2826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaaggaggggaguagagtt

SEQ ID NO: 2827 - RNA, 19 nt, Artificial Sequence
  source: /note="Description of Artificial Sequence: Synthetic oligonucleotide"
cucuacuccccuccuucca

SEQ ID NO: 2828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuacuccccuccuuccatt

SEQ ID NO: 2829 - RNA, 19 nt, Artificial Sequence
  source: /note="Description of Artificial Sequence: Synthetic oligonucleotide"
ggaaggaggggaguagaga

SEQ ID NO: 2830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaggaggggaguagagatt

SEQ ID NO: 2831 - RNA, 19 nt, Artificial Sequence
  source: /note="Description of Artificial Sequence: Synthetic oligonucleotide"
ucucuacuccccuccuucc

SEQ ID NO: 2832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucuacuccccuccuucctt

SEQ ID NO: 2833 - RNA, 19 nt, Artificial Sequence
  source: /note="Description of Artificial Sequence: Synthetic oligonucleotide"
gaaggaggggaguagagag

SEQ ID NO: 2834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggaggggaguagagagtt

SEQ ID NO: 2835 - RNA, 19 nt, Artificial Sequence
  source: /note="Description of Artificial Sequence: Synthetic oligonucleotide"
cucucuacuccccuccuuc

SEQ ID NO: 2836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucuacuccccuccuuctt

SEQ ID NO: 2837 - RNA, 19 nt, Artificial Sequence
  source: /note="Description of Artificial Sequence: Synthetic oligonucleotide"
aggggaguagagagagucc

SEQ ID NO: 2838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggaguagagagagucctt

SEQ ID NO: 2839 - RNA, 19 nt, Artificial Sequence
  source: /note="Description of Artificial Sequence: Synthetic oligonucleotide"
ggacucucucuacuccccu

SEQ ID NO: 2840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacucucucuacuccccutt

SEQ ID NO: 2841 - RNA, 19 nt, Artificial Sequence
  source: /note="Description of Artificial Sequence: Synthetic oligonucleotide"
ggggaguagagagaguccc

SEQ ID NO: 2842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaguagagagaguccctt

SEQ ID NO: 2843 - RNA, 19 nt, Artificial Sequence
  source: /note="Description of Artificial Sequence: Synthetic oligonucleotide"
gggacucucucuacucccc

SEQ ID NO: 2844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggacucucucuacucccctt

SEQ ID NO: 2845 - RNA, 19 nt, Artificial Sequence
  source: /note="Description of Artificial Sequence: Synthetic oligonucleotide"
gaguagagagagucccugg

SEQ ID NO: 2846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguagagagagucccuggtt

SEQ ID NO: 2847 - RNA, 19 nt, Artificial Sequence
  source: /note="Description of Artificial Sequence: Synthetic oligonucleotide"
ccagggacucucucuacuc

SEQ ID NO: 2848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggacucucucuacuctt

SEQ ID NO: 2849 - RNA, 19 nt, Artificial Sequence
  source: /note="Description of Artificial Sequence: Synthetic oligonucleotide"
agagagagucccugguguc

SEQ ID NO: 2850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagagagucccugguguctt

SEQ ID NO: 2851 - RNA, 19 nt, Artificial Sequence
  source: /note="Description of Artificial Sequence: Synthetic oligonucleotide"
gacaccagggacucucucu

SEQ ID NO: 2852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaccagggacucucucutt

SEQ ID NO: 2853 - RNA, 19 nt, Artificial Sequence
  source: /note="Description of Artificial Sequence: Synthetic oligonucleotide"
gagucccuggugucuuagu

SEQ ID NO: 2854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagucccuggugucuuagutt

SEQ ID NO: 2855 - RNA, 19 nt, Artificial Sequence
  source: /note="Description of Artificial Sequence: Synthetic oligonucleotide"
acuaagacaccagggacuc

SEQ ID NO: 2856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuaagacaccagggacuctt

SEQ ID NO: 2857 - RNA, 19 nt, Artificial Sequence
  source: /note="Description of Artificial Sequence: Synthetic oligonucleotide"
agucccuggugucuuaguu

SEQ ID NO: 2858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucccuggugucuuaguutt

SEQ ID NO: 2859 - RNA, 19 nt, Artificial Sequence
  source: /note="Description of Artificial Sequence: Synthetic oligonucleotide"
aacuaagacaccagggacu

SEQ ID NO: 2860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuaagacaccagggacutt

SEQ ID NO: 2861 - RNA, 19 nt, Artificial Sequence
  source: /note="Description of Artificial Sequence: Synthetic oligonucleotide"
cccuggugucuuaguuucc

SEQ ID NO: 2862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggugucuuaguuucctt

SEQ ID NO: 2863 - RNA, 19 nt, Artificial Sequence
  source: /note="Description of Artificial Sequence: Synthetic oligonucleotide"
ggaaacuaagacaccaggg

SEQ ID NO: 2864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaacuaagacaccagggtt

SEQ ID NO: 2865 - RNA, 19 nt, Artificial Sequence
  source: /note="Description of Artificial Sequence: Synthetic oligonucleotide"
ccuggugucuuaguuucca

SEQ ID NO: 2866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggugucuuaguuuccatt

SEQ ID NO: 2867 - RNA, 19 nt, Artificial Sequence
  source: /note="Description of Artificial Sequence: Synthetic oligonucleotide"
uggaaacuaagacaccagg

SEQ ID NO: 2868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaaacuaagacaccaggtt

SEQ ID NO: 2869 - RNA, 19 nt, Artificial Sequence
  source: /note="Description of Artificial Sequence: Synthetic oligonucleotide"
ugucuuaguuuccacagua

SEQ ID NO: 2870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucuuaguuuccacaguatt

SEQ ID NO: 2871 - RNA, 19 nt, Artificial Sequence
  source: /note="Description of Artificial Sequence: Synthetic oligonucleotide"
uacuguggaaacuaagaca

SEQ ID NO: 2872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuguggaaacuaagacatt

SEQ ID NO: 2873 - RNA, 19 nt, Artificial Sequence
  source: /note="Description of Artificial Sequence: Synthetic oligonucleotide"
uccacaguaagguuugccu

SEQ ID NO: 2874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacaguaagguuugccutt

SEQ ID NO: 2875 - RNA, 19 nt, Artificial Sequence
  source: /note="Description of Artificial Sequence: Synthetic oligonucleotide"
aggcaaaccuuacugugga

SEQ ID NO: 2876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcaaaccuuacuguggatt

SEQ ID NO: 2877 - RNA, 19 nt, Artificial Sequence
  source: /note="Description of Artificial Sequence: Synthetic oligonucleotide"
ccacaguaagguuugccug

SEQ ID NO: 2878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaguaagguuugccugtt

SEQ ID NO: 2879 - RNA, 19 nt, Artificial Sequence
  source: /note="Description of Artificial Sequence: Synthetic oligonucleotide"
caggcaaaccuuacugugg

SEQ ID NO: 2880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcaaaccuuacuguggtt

SEQ ID NO: 2881 - RNA, 19 nt, Artificial Sequence
  source: /note="Description of Artificial Sequence: Synthetic oligonucleotide"
cacaguaagguuugccugu

SEQ ID NO: 2882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaguaagguuugccugutt

SEQ ID NO: 2883 - RNA, 19 nt, Artificial Sequence
  source: /note="Description of Artificial Sequence: Synthetic oligonucleotide"
acaggcaaaccuuacugug

SEQ ID NO: 2884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaggcaaaccuuacugugtt

SEQ ID NO: 2885 - RNA, 19 nt, Artificial Sequence
  source: /note="Description of Artificial Sequence: Synthetic oligonucleotide"
acaguaagguuugccugug

SEQ ID NO: 2886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguaagguuugccugugtt

SEQ ID NO: 2887 - RNA, 19 nt, Artificial Sequence
  source: /note="Description of Artificial Sequence: Synthetic oligonucleotide"
cacaggcaaaccuuacugu

SEQ ID NO: 2888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaggcaaaccuuacugutt

SEQ ID NO: 2889 - RNA, 19 nt, Artificial Sequence
  source: /note="Description of Artificial Sequence: Synthetic oligonucleotide"
aguaagguuugccugugua

SEQ ID NO: 2890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaagguuugccuguguatt

SEQ ID NO: 2891 - RNA, 19 nt, Artificial Sequence
  source: /note="Description of Artificial Sequence: Synthetic oligonucleotide"
uacacaggcaaaccuuacu

SEQ ID NO: 2892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacaggcaaaccuuacutt

SEQ ID NO: 2893 - RNA, 19 nt, Artificial Sequence
  source: /note="Description of Artificial Sequence: Synthetic oligonucleotide"
guaagguuugccuguguac

SEQ ID NO: 2894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaagguuugccuguguactt

SEQ ID NO: 2895 - RNA, 19 nt, Artificial Sequence
  source: /note="Description of Artificial Sequence: Synthetic oligonucleotide"
guacacaggcaaaccuuac

SEQ ID NO: 2896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacacaggcaaaccuuactt

SEQ ID NO: 2897 - RNA, 19 nt, Artificial Sequence
  source: /note="Description of Artificial Sequence: Synthetic oligonucleotide"
uaagguuugccuguguaca

SEQ ID NO: 2898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagguuugccuguguacatt

SEQ ID NO: 2899 - RNA, 19 nt, Artificial Sequence
  source: /note="Description of Artificial Sequence: Synthetic oligonucleotide"
uguacacaggcaaaccuua

SEQ ID NO: 2900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacacaggcaaaccuuatt

SEQ ID NO: 2901 - RNA, 19 nt, Artificial Sequence
  source: /note="Description of Artificial Sequence: Synthetic oligonucleotide"
uuugccuguguacagaccu

SEQ ID NO: 2902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugccuguguacagaccutt

SEQ ID NO: 2903 - RNA, 19 nt, Artificial Sequence
  source: /note="Description of Artificial Sequence: Synthetic oligonucleotide"
aggucuguacacaggcaaa

SEQ ID NO: 2904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggucuguacacaggcaaatt

SEQ ID NO: 2905 - RNA, 19 nt, Artificial Sequence
  source: /note="Description of Artificial Sequence: Synthetic oligonucleotide"
uugccuguguacagaccuc

SEQ ID NO: 2906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugccuguguacagaccuctt

SEQ ID NO: 2907 - RNA, 19 nt, Artificial Sequence
  source: /note="Description of Artificial Sequence: Synthetic oligonucleotide"
gaggucuguacacaggcaa

SEQ ID NO: 2908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggucuguacacaggcaatt

SEQ ID NO: 2909 - RNA, 19 nt, Artificial Sequence
  source: /note="Description of Artificial Sequence: Synthetic oligonucleotide"
ccuguguacagaccucugu

SEQ ID NO: 2910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuguguacagaccucugutt

SEQ ID NO: 2911 - RNA, 19 nt, Artificial Sequence
  source: /note="Description of Artificial Sequence: Synthetic oligonucleotide"
acagaggucuguacacagg

SEQ ID NO: 2912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagaggucuguacacaggtt

SEQ ID NO: 2913 - RNA, 19 nt, Artificial Sequence
  source: /note="Description of Artificial Sequence: Synthetic oligonucleotide"
cuguguacagaccucuguu

SEQ ID NO: 2914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguguacagaccucuguutt

SEQ ID NO: 2915 - RNA, 19 nt, Artificial Sequence
  source: /note="Description of Artificial Sequence: Synthetic oligonucleotide"
aacagaggucuguacacag

SEQ ID NO: 2916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacagaggucuguacacagtt

SEQ ID NO: 2917 - RNA, 19 nt, Artificial Sequence
  source: /note="Description of Artificial Sequence: Synthetic oligonucleotide"
uacagaccucuguucaaua

SEQ ID NO: 2918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagaccucuguucaauatt

SEQ ID NO: 2919 - RNA, 19 nt, Artificial Sequence
  source: /note="Description of Artificial Sequence: Synthetic oligonucleotide"
uauugaacagaggucugua

SEQ ID NO: 2920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauugaacagaggucuguatt

SEQ ID NO: 2921 - RNA, 19 nt, Artificial Sequence
  source: /note="Description of Artificial Sequence: Synthetic oligonucleotide"
gaccucuguucaauaaauu

SEQ ID NO: 2922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccucuguucaauaaauutt

SEQ ID NO: 2923 - RNA, 19 nt, Artificial Sequence
  source: /note="Description of Artificial Sequence: Synthetic oligonucleotide"
aauuuauugaacagagguc

SEQ ID NO: 2924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuuauugaacagagguctt

SEQ ID NO: 2925 - RNA, 19 nt, Artificial Sequence
  source: /note="Description of Artificial Sequence: Synthetic oligonucleotide"
caauaaauuauuggcauga

SEQ ID NO: 2926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauaaauuauuggcaugatt

SEQ ID NO: 2927 - RNA, 19 nt, Artificial Sequence
  source: /note="Description of Artificial Sequence: Synthetic oligonucleotide"
ucaugccaauaauuuauug

SEQ ID NO: 2928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaugccaauaauuuauugtt

SEQ ID NO: 2929 - RNA, 19 nt, Artificial Sequence
  source: /note="Description of Artificial Sequence: Synthetic oligonucleotide"
cgcggcgggcgcugggccg

SEQ ID NO: 2930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggcgggcgcugggccgtt

SEQ ID NO: 2931 - RNA, 19 nt, Artificial Sequence
  source: /note="Description of Artificial Sequence: Synthetic oligonucleotide"
cggcccagcgcccgccgcg

SEQ ID NO: 2932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcccagcgcccgccgcgtt

SEQ ID NO: 2933 - RNA, 19 nt, Artificial Sequence
  source: /note="Description of Artificial Sequence: Synthetic oligonucleotide"
ugggccugcgcucggcgcc

SEQ ID NO: 2934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccugcgcucggcgcctt

SEQ ID NO: 2935 - RNA, 19 nt, Artificial Sequence
  source: /note="Description of Artificial Sequence: Synthetic oligonucleotide"
ggcgccgagcgcaggccca

SEQ ID NO: 2936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgccgagcgcaggcccatt

SEQ ID NO: 2937 - RNA, 19 nt, Artificial Sequence
  source: /note="Description of Artificial Sequence: Synthetic oligonucleotide"
ggccuucgggaggcggccc

SEQ ID NO: 2938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuucgggaggcggccctt

SEQ ID NO: 2939 - RNA, 19 nt, Artificial Sequence
  source: /note="Description of Artificial Sequence: Synthetic oligonucleotide"
gggccgccucccgaaggcc

SEQ ID NO: 2940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccgccucccgaaggcctt

SEQ ID NO: 2941 - RNA, 19 nt, Artificial Sequence
  source: /note="Description of Artificial Sequence: Synthetic oligonucleotide"
cccugggggcucgggccgg

SEQ ID NO: 2942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugggggcucgggccggtt

SEQ ID NO: 2943 - RNA, 19 nt, Artificial Sequence
  source: /note="Description of Artificial Sequence: Synthetic oligonucleotide"
ccggcccgagcccccaggg

SEQ ID NO: 2944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcccgagcccccagggtt

SEQ ID NO: 2945 - RNA, 19 nt, Artificial Sequence
  source: /note="Description of Artificial Sequence: Synthetic oligonucleotide"
ugggggcucgggccgggcg

SEQ ID NO: 2946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggggcucgggccgggcgtt

SEQ ID NO: 2947 - RNA, 19 nt, Artificial Sequence
  source: /note="Description of Artificial Sequence: Synthetic oligonucleotide"
cgcccggcccgagccccca

SEQ ID NO: 2948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcccggcccgagcccccatt

SEQ ID NO: 2949 - RNA, 19 nt, Artificial Sequence
  source: /note="Description of Artificial Sequence: Synthetic oligonucleotide"
ggggguggccccagcggca

SEQ ID NO: 2950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggguggccccagcggcatt

SEQ ID NO: 2951 - RNA, 19 nt, Artificial Sequence
  source: /note="Description of Artificial Sequence: Synthetic oligonucleotide"
ugccgcuggggccaccccc

SEQ ID NO: 2952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccgcuggggccaccccctt

SEQ ID NO: 2953 - RNA, 19 nt, Artificial Sequence
  source: /note="Description of Artificial Sequence: Synthetic oligonucleotide"
uggccccagcggcagcggc

SEQ ID NO: 2954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccccagcggcagcggctt

SEQ ID NO: 2955 - RNA, 19 nt, Artificial Sequence
  source: /note="Description of Artificial Sequence: Synthetic oligonucleotide"
gccgcugccgcuggggcca

SEQ ID NO: 2956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcugccgcuggggccatt

SEQ ID NO: 2957 - RNA, 19 nt, Artificial Sequence
  source: /note="Description of Artificial Sequence: Synthetic oligonucleotide"
aagcugggccgugacagcg

SEQ ID NO: 2958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcugggccgugacagcgtt

SEQ ID NO: 2959 - RNA, 19 nt, Artificial Sequence
  source: /note="Description of Artificial Sequence: Synthetic oligonucleotide"
cgcugucacggcccagcuu

SEQ ID NO: 2960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugucacggcccagcuutt

SEQ ID NO: 2961 - RNA, 19 nt, Artificial Sequence
  source: /note="Description of Artificial Sequence: Synthetic oligonucleotide"
ccacuguaggccaaggccc

SEQ ID NO: 2962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuguaggccaaggccctt

SEQ ID NO: 2963 - RNA, 19 nt, Artificial Sequence
  source: /note="Description of Artificial Sequence: Synthetic oligonucleotide"
gggccuuggccuacagugg

SEQ ID NO: 2964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccuuggccuacaguggtt

SEQ ID NO: 2965 - RNA, 19 nt, Artificial Sequence
  source: /note="Description of Artificial Sequence: Synthetic oligonucleotide"
aguauaccaggcacggcug

SEQ ID NO: 2966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguauaccaggcacggcugtt

SEQ ID NO: 2967 - RNA, 19 nt, Artificial Sequence
  source: /note="Description of Artificial Sequence: Synthetic oligonucleotide"
cagccgugccugguauacu

SEQ ID NO: 2968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccgugccugguauacutt

SEQ ID NO: 2969 - RNA, 19 nt, Artificial Sequence
  source: /note="Description of Artificial Sequence: Synthetic oligonucleotide"
ggcuggcagagacgaggga

SEQ ID NO: 2970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuggcagagacgagggatt

SEQ ID NO: 2971 - RNA, 19 nt, Artificial Sequence
  source: /note="Description of Artificial Sequence: Synthetic oligonucleotide"
ucccucgucucugccagcc

SEQ ID NO: 2972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucgucucugccagcctt

SEQ ID NO: 2973 - RNA, 19 nt, Artificial Sequence
  source: /note="Description of Artificial Sequence: Synthetic oligonucleotide"
gaagaaggacgagcuguau

SEQ ID NO: 2974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaaggacgagcuguautt

SEQ ID NO: 2975 - RNA, 19 nt, Artificial Sequence
  source: /note="Description of Artificial Sequence: Synthetic oligonucleotide"
auacagcucguccuucuuc

SEQ ID NO: 2976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacagcucguccuucuuctt

SEQ ID NO: 2977 - RNA, 19 nt, Artificial Sequence
  source: /note="Description of Artificial Sequence: Synthetic oligonucleotide"
aagccccagaauuugcuug

SEQ ID NO: 2978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccccagaauuugcuugtt

SEQ ID NO: 2979 - RNA, 19 nt, Artificial Sequence
  source: /note="Description of Artificial Sequence: Synthetic oligonucleotide"
caagcaaauucuggggcuu

SEQ ID NO: 2980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcaaauucuggggcuutt

SEQ ID NO: 2981 - RNA, 19 nt, Artificial Sequence
  source: /note="Description of Artificial Sequence: Synthetic oligonucleotide"
ccagaauuugcuuguggac

SEQ ID NO: 2982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaauuugcuuguggactt

SEQ ID NO: 2983 - RNA, 19 nt, Artificial Sequence
  source: /note="Description of Artificial Sequence: Synthetic oligonucleotide"
guccacaagcaaauucugg

SEQ ID NO: 2984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccacaagcaaauucuggtt

SEQ ID NO: 2985 - RNA, 19 nt, Artificial Sequence
  source: /note="Description of Artificial Sequence: Synthetic oligonucleotide"
cagaacucaucuuuggagc

SEQ ID NO: 2986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaacucaucuuuggagctt

SEQ ID NO: 2987 - RNA, 19 nt, Artificial Sequence
  source: /note="Description of Artificial Sequence: Synthetic oligonucleotide"
gcuccaaagaugaguucug

SEQ ID NO: 2988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccaaagaugaguucugtt

SEQ ID NO: 2989 - RNA, 19 nt, Artificial Sequence
  source: /note="Description of Artificial Sequence: Synthetic oligonucleotide"
ucaucuuuggagccacaga

SEQ ID NO: 2990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucuuuggagccacagatt

SEQ ID NO: 2991 - RNA, 19 nt, Artificial Sequence
  source: /note="Description of Artificial Sequence: Synthetic oligonucleotide"
ucuguggcuccaaagauga

SEQ ID NO: 2992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguggcuccaaagaugatt

SEQ ID NO: 2993 - RNA, 19 nt, Artificial Sequence
  source: /note="Description of Artificial Sequence: Synthetic oligonucleotide"
ggagccacagauuacaccu

SEQ ID NO: 2994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagccacagauuacaccutt

SEQ ID NO: 2995 - RNA, 19 nt, Artificial Sequence
  source: /note="Description of Artificial Sequence: Synthetic oligonucleotide"
agguguaaucuguggcucc

SEQ ID NO: 2996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguguaaucuguggcucctt

SEQ ID NO: 2997 - RNA, 19 nt, Artificial Sequence
  source: /note="Description of Artificial Sequence: Synthetic oligonucleotide"
cgauguguggucggcuggc

SEQ ID NO: 2998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgauguguggucggcuggctt

SEQ ID NO: 2999 - RNA, 19 nt, Artificial Sequence
  source: /note="Description of Artificial Sequence: Synthetic oligonucleotide"
gccagccgaccacacaucg

SEQ ID NO: 3000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagccgaccacacaucgtt

SEQ ID NO: 3001 - RNA, 19 nt, Artificial Sequence
  source: /note="Description of Artificial Sequence: Synthetic oligonucleotide"
gcuggcuguguacuugcug

SEQ ID NO: 3002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggcuguguacuugcugtt

SEQ ID NO: 3003 - RNA, 19 nt, Artificial Sequence
  source: /note="Description of Artificial Sequence: Synthetic oligonucleotide"
cagcaaguacacagccagc

SEQ ID NO: 3004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaaguacacagccagctt

SEQ ID NO: 3005 - RNA, 19 nt, Artificial Sequence
  source: /note="Description of Artificial Sequence: Synthetic oligonucleotide"
cuggcuguguacuugcuga

SEQ ID NO: 3006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcuguguacuugcugatt

SEQ ID NO: 3007 - RNA, 19 nt, Artificial Sequence
  source: /note="Description of Artificial Sequence: Synthetic oligonucleotide"
ucagcaaguacacagccag

SEQ ID NO: 3008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagcaaguacacagccagtt

SEQ ID NO: 3009 - RNA, 19 nt, Artificial Sequence
  source: /note="Description of Artificial Sequence: Synthetic oligonucleotide"
gccagcccaucuucccugg

SEQ ID NO: 3010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagcccaucuucccuggtt

SEQ ID NO: 3011 - RNA, 19 nt, Artificial Sequence
  source: /note="Description of Artificial Sequence: Synthetic oligonucleotide"
ccagggaagaugggcuggc

SEQ ID NO: 3012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggaagaugggcuggctt

SEQ ID NO: 3013 - RNA, 19 nt, Artificial Sequence
  source: /note="Description of Artificial Sequence: Synthetic oligonucleotide"
uucccuggggacagugggg

SEQ ID NO: 3014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccuggggacaguggggtt

SEQ ID NO: 3015 - RNA, 19 nt, Artificial Sequence
  source: /note="Description of Artificial Sequence: Synthetic oligonucleotide"
ccccacuguccccagggaa

SEQ ID NO: 3016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccacuguccccagggaatt

SEQ ID NO: 3017 - RNA, 19 nt, Artificial Sequence
  source: /note="Description of Artificial Sequence: Synthetic oligonucleotide"
cuggugaacuguccaucca

SEQ ID NO: 3018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggugaacuguccauccatt

SEQ ID NO: 3019 - RNA, 19 nt, Artificial Sequence
  source: /note="Description of Artificial Sequence: Synthetic oligonucleotide"
uggauggacaguucaccag

SEQ ID NO: 3020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggauggacaguucaccagtt

SEQ ID NO: 3021 - RNA, 19 nt, Artificial Sequence
  source: /note="Description of Artificial Sequence: Synthetic oligonucleotide"
aacuguccauccaaccauc

SEQ ID NO: 3022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuguccauccaaccauctt

SEQ ID NO: 3023 - RNA, 19 nt, Artificial Sequence
  source: /note="Description of Artificial Sequence: Synthetic oligonucleotide"
gaugguuggauggacaguu

SEQ ID NO: 3024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugguuggauggacaguutt

SEQ ID NO: 3025 - RNA, 19 nt, Artificial Sequence
  source: /note="Description of Artificial Sequence: Synthetic oligonucleotide"
cccucaccacuuccuacaa

SEQ ID NO: 3026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucaccacuuccuacaatt

SEQ ID NO: 3027 - RNA, 19 nt, Artificial Sequence
  source: /note="Description of Artificial Sequence: Synthetic oligonucleotide"
uuguaggaaguggugaggg

SEQ ID NO: 3028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguaggaaguggugagggtt

SEQ ID NO: 3029 - RNA, 19 nt, Artificial Sequence
  source: /note="Description of Artificial Sequence: Synthetic oligonucleotide"
aggauuuuaacuguuugua

SEQ ID NO: 3030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggauuuuaacuguuuguatt

SEQ ID NO: 3031 - RNA, 19 nt, Artificial Sequence
  source: /note="Description of Artificial Sequence: Synthetic oligonucleotide"
uacaaacaguuaaaauccu

SEQ ID NO: 3032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaaacaguuaaaauccutt

SEQ ID NO: 3033 - RNA, 19 nt, Artificial Sequence
  source: /note="Description of Artificial Sequence: Synthetic oligonucleotide"
ccuggguguaaauagauug

SEQ ID NO: 3034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggguguaaauagauugtt

SEQ ID NO: 3035 - RNA, 19 nt, Artificial Sequence
  source: /note="Description of Artificial Sequence: Synthetic oligonucleotide"
caaucuauuuacacccagg

SEQ ID NO: 3036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaucuauuuacacccaggtt

SEQ ID NO: 3037 - RNA, 19 nt, Artificial Sequence
  source: /note="Description of Artificial Sequence: Synthetic oligonucleotide"
auagauuguuauaauuuuu

SEQ ID NO: 3038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagauuguuauaauuuuutt

SEQ ID NO: 3039 - RNA, 19 nt, Artificial Sequence
  source: /note="Description of Artificial Sequence: Synthetic oligonucleotide"
aaaaauuauaacaaucuau

SEQ ID NO: 3040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaauuauaacaaucuautt

SEQ ID NO: 3041 - RNA, 19 nt, Artificial Sequence
  source: /note="Description of Artificial Sequence: Synthetic oligonucleotide"
ugcucccaaggcuuccucc

SEQ ID NO: 3042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcucccaaggcuuccucctt

SEQ ID NO: 3043 - RNA, 19 nt, Artificial Sequence
  source: /note="Description of Artificial Sequence: Synthetic oligonucleotide"
ggaggaagccuugggagca

SEQ ID NO: 3044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggaagccuugggagcatt

SEQ ID NO: 3045 - RNA, 19 nt, Artificial Sequence
  source: /note="Description of Artificial Sequence: Synthetic oligonucleotide"
uguucaauaaauuauuggc

SEQ ID NO: 3046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucaauaaauuauuggctt

SEQ ID NO: 3047 - RNA, 19 nt, Artificial Sequence
  source: /note="Description of Artificial Sequence: Synthetic oligonucleotide"
gccaauaauuuauugaaca

SEQ ID NO: 3048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaauaauuuauugaacatt

SEQ ID NO: 3049 - RNA, 19 nt, Artificial Sequence
  source: /note="Description of Artificial Sequence: Synthetic oligonucleotide"
ccccgcggcgggcgcuggg

SEQ ID NO: 3050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgcggcgggcgcugggtt

SEQ ID NO: 3051 - RNA, 19 nt, Artificial Sequence
  source: /note="Description of Artificial Sequence: Synthetic oligonucleotide"
cccagcgcccgccgcgggg

SEQ ID NO: 3052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcgcccgccgcggggtt

SEQ ID NO: 3053 - RNA, 19 nt, Artificial Sequence
  source: /note="Description of Artificial Sequence: Synthetic oligonucleotide"
ccgcggcgggcgcugggcc

SEQ ID NO: 3054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcggcgggcgcugggcctt

SEQ ID NO: 3055 - RNA, 19 nt, Artificial Sequence
  source: /note="Description of Artificial Sequence: Synthetic oligonucleotide"
ggcccagcgcccgccgcgg

SEQ ID NO: 3056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccagcgcccgccgcggtt

SEQ ID NO: 3057 - RNA, 19 nt, Artificial Sequence
  source: /note="Description of Artificial Sequence: Synthetic oligonucleotide"
cgggcgcugggccggagcc

SEQ ID NO: 3058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcgcugggccggagcctt

SEQ ID NO: 3059 - RNA, 19 nt, Artificial Sequence
  source: /note="Description of Artificial Sequence: Synthetic oligonucleotide"
ggcuccggcccagcgcccg

SEQ ID NO: 3060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccggcccagcgcccgtt

SEQ ID NO: 3061 - RNA, 19 nt, Artificial Sequence
  source: /note="Description of Artificial Sequence: Synthetic oligonucleotide"
gcggccuggaagaggccgg

SEQ ID NO: 3062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggccuggaagaggccggtt

SEQ ID NO: 3063 - RNA, 19 nt, Artificial Sequence
  source: /note="Description of Artificial Sequence: Synthetic oligonucleotide"
ccggccucuuccaggccgc

SEQ ID NO: 3064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggccucuuccaggccgctt

SEQ ID NO: 3065 - RNA, 19 nt, Artificial Sequence
  source: /note="Description of Artificial Sequence: Synthetic oligonucleotide"
ggccuggaagaggccggag

SEQ ID NO: 3066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuggaagaggccggagtt

SEQ ID NO: 3067 - RNA, 19 nt, Artificial Sequence
  source: /note="Description of Artificial Sequence: Synthetic oligonucleotide"
cuccggccucuuccaggcc

SEQ ID NO: 3068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggccucuuccaggcctt

SEQ ID NO: 3069 - RNA, 19 nt, Artificial Sequence
  source: /note="Description of Artificial Sequence: Synthetic oligonucleotide"
uggaagaggccggagccca

SEQ ID NO: 3070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaagaggccggagcccatt

SEQ ID NO: 3071 - RNA, 19 nt, Artificial Sequence
  source: /note="Description of Artificial Sequence: Synthetic oligonucleotide"
ugggcuccggccucuucca

SEQ ID NO: 3072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuccggccucuuccatt

SEQ ID NO: 3073 - RNA, 19 nt, Artificial Sequence
  source: /note="Description of Artificial Sequence: Synthetic oligonucleotide"
ggaagaggccggagcccag

SEQ ID NO: 3074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagaggccggagcccagtt

SEQ ID NO: 3075 - RNA, 19 nt, Artificial Sequence
  source: /note="Description of Artificial Sequence: Synthetic oligonucleotide"
cugggcuccggccucuucc

SEQ ID NO: 3076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggcuccggccucuucctt

SEQ ID NO: 3077 - RNA, 19 nt, Artificial Sequence
  source: /note="Description of Artificial Sequence: Synthetic oligonucleotide"
gccggagcccaggggaggc

SEQ ID NO: 3078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccggagcccaggggaggctt

SEQ ID NO: 3079 - RNA, 19 nt, Artificial Sequence
  source: /note="Description of Artificial Sequence: Synthetic oligonucleotide"
gccuccccugggcuccggc

SEQ ID NO: 3080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuccccugggcuccggctt

SEQ ID NO: 3081 - RNA, 19 nt, Artificial Sequence
  source: /note="Description of Artificial Sequence: Synthetic oligonucleotide"
ccggagcccaggggaggcg

SEQ ID NO: 3082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagcccaggggaggcgtt

SEQ ID NO: 3083 - RNA, 19 nt, Artificial Sequence
  source: /note="Description of Artificial Sequence: Synthetic oligonucleotide"
cgccuccccugggcuccgg

SEQ ID NO: 3084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccuccccugggcuccggtt

SEQ ID NO: 3085 - RNA, 19 nt, Artificial Sequence
  source: /note="Description of Artificial Sequence: Synthetic oligonucleotide"
cggagcccaggggaggcgg

SEQ ID NO: 3086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagcccaggggaggcggtt

SEQ ID NO: 3087 - RNA, 19 nt, Artificial Sequence
  source: /note="Description of Artificial Sequence: Synthetic oligonucleotide"
ccgccuccccugggcuccg

SEQ ID NO: 3088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccuccccugggcuccgtt

SEQ ID NO: 3089 - RNA, 19 nt, Artificial Sequence
  source: /note="Description of Artificial Sequence: Synthetic oligonucleotide"
agcggcgggggcagcccag

SEQ ID NO: 3090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcggcgggggcagcccagtt

SEQ ID NO: 3091 - RNA, 19 nt, Artificial Sequence
  source: /note="Description of Artificial Sequence: Synthetic oligonucleotide"
cugggcugcccccgccgcu

SEQ ID NO: 3092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggcugcccccgccgcutt

SEQ ID NO: 3093 - RNA, 19 nt, Artificial Sequence
  source: /note="Description of Artificial Sequence: Synthetic oligonucleotide"
gcccaggcagcccgagccc

SEQ ID NO: 3094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaggcagcccgagccctt

SEQ ID NO: 3095 - RNA, 19 nt, Artificial Sequence
  source: /note="Description of Artificial Sequence: Synthetic oligonucleotide"
gggcucgggcugccugggc

SEQ ID NO: 3096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcucgggcugccugggctt

SEQ ID NO: 3097 - RNA, 19 nt, Artificial Sequence
  source: /note="Description of Artificial Sequence: Synthetic oligonucleotide"
ccgagccccgcggccuggg

SEQ ID NO: 3098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagccccgcggccugggtt

SEQ ID NO: 3099 - RNA, 19 nt, Artificial Sequence
  source: /note="Description of Artificial Sequence: Synthetic oligonucleotide"
cccaggccgcggggcucgg

SEQ ID NO: 3100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggccgcggggcucggtt

SEQ ID NO: 3101 - RNA, 19 nt, Artificial Sequence
  source: /note="Description of Artificial Sequence: Synthetic oligonucleotide"
gcggccugggccugcgcuc

SEQ ID NO: 3102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggccugggccugcgcuctt

SEQ ID NO: 3103 - RNA, 19 nt, Artificial Sequence
  source: /note="Description of Artificial Sequence: Synthetic oligonucleotide"
gagcgcaggcccaggccgc

SEQ ID NO: 3104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcgcaggcccaggccgctt

SEQ ID NO: 3105 - RNA, 19 nt, Artificial Sequence
  source: /note="Description of Artificial Sequence: Synthetic oligonucleotide"
cugggccugcgcucggcgc

SEQ ID NO: 3106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccugcgcucggcgctt

SEQ ID NO: 3107 - RNA, 19 nt, Artificial Sequence
  source: /note="Description of Artificial Sequence: Synthetic oligonucleotide"
gcgccgagcgcaggcccag

SEQ ID NO: 3108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgccgagcgcaggcccagtt

SEQ ID NO: 3109 - RNA, 19 nt, Artificial Sequence
  source: /note="Description of Artificial Sequence: Synthetic oligonucleotide"
gggccuucgggaggcggcc

SEQ ID NO: 3110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccuucgggaggcggcctt

SEQ ID NO: 3111 - RNA, 19 nt, Artificial Sequence
  source: /note="Description of Artificial Sequence: Synthetic oligonucleotide"
ggccgccucccgaaggccc

SEQ ID NO: 3112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgccucccgaaggccctt

SEQ ID NO: 3113 - RNA, 19 nt, Artificial Sequence
  source: /note="Description of Artificial Sequence: Synthetic oligonucleotide"
uucgggaggcggcccuggg

SEQ ID NO: 3114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucgggaggcggcccugggtt

SEQ ID NO: 3115 - RNA, 19 nt, Artificial Sequence
  source: /note="Description of Artificial Sequence: Synthetic oligonucleotide"
cccagggccgccucccgaa

SEQ ID NO: 3116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagggccgccucccgaatt

SEQ ID NO: 3117 - RNA, 19 nt, Artificial Sequence
  source: /note="Description of Artificial Sequence: Synthetic oligonucleotide"
ucgggccgggcgcggacca

SEQ ID NO: 3118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgggccgggcgcggaccatt

SEQ ID NO: 3119 - RNA, 19 nt, Artificial Sequence
  source: /note="Description of Artificial Sequence: Synthetic oligonucleotide"
ugguccgcgcccggcccga

SEQ ID NO: 3120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguccgcgcccggcccgatt

SEQ ID NO: 3121 - RNA, 19 nt, Artificial Sequence
  source: /note="Description of Artificial Sequence: Synthetic oligonucleotide"
ucgcggagccaggaggcgg

SEQ ID NO: 3122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgcggagccaggaggcggtt

SEQ ID NO: 3123 - RNA, 19 nt, Artificial Sequence
  source: /note="Description of Artificial Sequence: Synthetic oligonucleotide"
ccgccuccuggcuccgcga

SEQ ID NO: 3124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccuccuggcuccgcgatt

SEQ ID NO: 3125 - RNA, 19 nt, Artificial Sequence
  source: /note="Description of Artificial Sequence: Synthetic oligonucleotide"
ggccccgggggcucggccu

SEQ ID NO: 3126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccgggggcucggccutt

SEQ ID NO: 3127 - RNA, 19 nt, Artificial Sequence
  source: /note="Description of Artificial Sequence: Synthetic oligonucleotide"
aggccgagcccccggggcc

SEQ ID NO: 3128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccgagcccccggggcctt

SEQ ID NO: 3129 - RNA, 19 nt, Artificial Sequence
  source: /note="Description of Artificial Sequence: Synthetic oligonucleotide"
gccccgggggcucggccuc

SEQ ID NO: 3130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccgggggcucggccuctt

SEQ ID NO: 3131 - RNA, 19 nt, Artificial Sequence
  source: /note="Description of Artificial Sequence: Synthetic oligonucleotide"
gaggccgagcccccggggc

SEQ ID NO: 3132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggccgagcccccggggctt

SEQ ID NO: 3133 - RNA, 19 nt, Artificial Sequence
  source: /note="Description of Artificial Sequence: Synthetic oligonucleotide"
ccaggaggcacuggcggcg

SEQ ID NO: 3134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggaggcacuggcggcgtt

SEQ ID NO: 3135 - RNA, 19 nt, Artificial Sequence
  source: /note="Description of Artificial Sequence: Synthetic oligonucleotide"
cgccgccagugccuccugg

SEQ ID NO: 3136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgccagugccuccuggtt

SEQ ID NO: 3137 - RNA, 19 nt, Artificial Sequence
  source: /note="Description of Artificial Sequence: Synthetic oligonucleotide"
gugggagccucgagcuccg

SEQ ID NO: 3138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugggagccucgagcuccgtt

SEQ ID NO: 3139 - RNA, 19 nt, Artificial Sequence
  source: /note="Description of Artificial Sequence: Synthetic oligonucleotide"
cggagcucgaggcucccac

SEQ ID NO: 3140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagcucgaggcucccactt

SEQ ID NO: 3141 - RNA, 19 nt, Artificial Sequence
  source: /note="Description of Artificial Sequence: Synthetic oligonucleotide"
cggggguggccccagcggc

SEQ ID NO: 3142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggguggccccagcggctt

SEQ ID NO: 3143 - RNA, 19 nt, Artificial Sequence
  source: /note="Description of Artificial Sequence: Synthetic oligonucleotide"
gccgcuggggccacccccg

SEQ ID NO: 3144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcuggggccacccccgtt

SEQ ID NO: 3145 - RNA, 19 nt, Artificial Sequence
  source: /note="Description of Artificial Sequence: Synthetic oligonucleotide"
gguggccccagcggcagcg

SEQ ID NO: 3146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggccccagcggcagcgtt

SEQ ID NO: 3147 - RNA, 19 nt, Artificial Sequence
  source: /note="Description of Artificial Sequence: Synthetic oligonucleotide"
cgcugccgcuggggccacc

SEQ ID NO: 3148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugccgcuggggccacctt

SEQ ID NO: 3149 - RNA, 19 nt, Artificial Sequence
  source: /note="Description of Artificial Sequence: Synthetic oligonucleotide"
guggccccagcggcagcgg

SEQ ID NO: 3150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggccccagcggcagcggtt

SEQ ID NO: 3151 - RNA, 19 nt, Artificial Sequence
  source: /note="Description of Artificial Sequence: Synthetic oligonucleotide"
ccgcugccgcuggggccac

SEQ ID NO: 3152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcugccgcuggggccactt

SEQ ID NO: 3153 - RNA, 19 nt, Artificial Sequence
  source: /note="Description of Artificial Sequence: Synthetic oligonucleotide"
gagugaagcugggccguga

SEQ ID NO: 3154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagugaagcugggccgugatt

SEQ ID NO: 3155 - RNA, 19 nt, Artificial Sequence
  source: /note="Description of Artificial Sequence: Synthetic oligonucleotide"
ucacggcccagcuucacuc

SEQ ID NO: 3156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacggcccagcuucacuctt

SEQ ID NO: 3157 - RNA, 19 nt, Artificial Sequence
  source: /note="Description of Artificial Sequence: Synthetic oligonucleotide"
gaccacagugguagccacu

SEQ ID NO: 3158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccacagugguagccacutt

SEQ ID NO: 3159 - RNA, 19 nt, Artificial Sequence
  source: /note="Description of Artificial Sequence: Synthetic oligonucleotide"
aguggcuaccacugugguc

SEQ ID NO: 3160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcuaccacugugguctt

SEQ ID NO: 3161 - RNA, 19 nt, Artificial Sequence
  source: /note="Description of Artificial Sequence: Synthetic oligonucleotide"
cacagugguagccacugua

SEQ ID NO: 3162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagugguagccacuguatt

SEQ ID NO: 3163 - RNA, 19 nt, Artificial Sequence
  source: /note="Description of Artificial Sequence: Synthetic oligonucleotide"
uacaguggcuaccacugug

SEQ ID NO: 3164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaguggcuaccacugugtt

SEQ ID NO: 3165 - RNA, 19 nt, Artificial Sequence
  source: /note="Description of Artificial Sequence: Synthetic oligonucleotide"
gccacuguaggccaaggcc

SEQ ID NO: 3166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacuguaggccaaggcctt

SEQ ID NO: 3167 - RNA, 19 nt, Artificial Sequence
  source: /note="Description of Artificial Sequence: Synthetic oligonucleotide"
ggccuuggccuacaguggc

SEQ ID NO: 3168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuuggccuacaguggctt

SEQ ID NO: 3169 - RNA, 19 nt, Artificial Sequence
  source: /note="Description of Artificial Sequence: Synthetic oligonucleotide"
ccaggcacggcuggcagag

SEQ ID NO: 3170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggcacggcuggcagagtt

SEQ ID NO: 3171 - RNA, 19 nt, Artificial Sequence
  source: /note="Description of Artificial Sequence: Synthetic oligonucleotide"
cucugccagccgugccugg

SEQ ID NO: 3172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugccagccgugccuggtt

SEQ ID NO: 3173 - RNA, 19 nt, Artificial Sequence
  source: /note="Description of Artificial Sequence: Synthetic oligonucleotide"
cggcuggcagagacgaggg

SEQ ID NO: 3174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcuggcagagacgagggtt

SEQ ID NO: 3175 - RNA, 19 nt, Artificial Sequence
  source: /note="Description of Artificial Sequence: Synthetic oligonucleotide"
cccucgucucugccagccg

SEQ ID NO: 3176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucgucucugccagccgtt

SEQ ID NO: 3177 - RNA, 19 nt, Artificial Sequence
  source: /note="Description of Artificial Sequence: Synthetic oligonucleotide"
cgagggaacugguggccau

SEQ ID NO: 3178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagggaacugguggccautt

SEQ ID NO: 3179 - RNA, 19 nt, Artificial Sequence
  source: /note="Description of Artificial Sequence: Synthetic oligonucleotide"
auggccaccaguucccucg

SEQ ID NO: 3180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggccaccaguucccucgtt

SEQ ID NO: 3181 - RNA, 19 nt, Artificial Sequence
  source: /note="Description of Artificial Sequence: Synthetic oligonucleotide"
caaaagguucaagaaccga

SEQ ID NO: 3182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaagguucaagaaccgatt

SEQ ID NO: 3183 - RNA, 19 nt, Artificial Sequence
  source: /note="Description of Artificial Sequence: Synthetic oligonucleotide"
ucgguucuugaaccuuuug

SEQ ID NO: 3184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguucuugaaccuuuugtt

SEQ ID NO: 3185 - RNA, 19 nt, Artificial Sequence
  source: /note="Description of Artificial Sequence: Synthetic oligonucleotide"
cuaucaucuacaucaaggu

SEQ ID NO: 3186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaucaucuacaucaaggutt

SEQ ID NO: 3187 - RNA, 19 nt, Artificial Sequence
  source: /note="Description of Artificial Sequence: Synthetic oligonucleotide"
accuugauguagaugauag

SEQ ID NO: 3188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuugauguagaugauagtt

SEQ ID NO: 3189 - RNA, 19 nt, Artificial Sequence
  source: /note="Description of Artificial Sequence: Synthetic oligonucleotide"
uaucaucuacaucaaggug

SEQ ID NO: 3190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucaucuacaucaaggugtt

SEQ ID NO: 3191 - RNA, 19 nt, Artificial Sequence
  source: /note="Description of Artificial Sequence: Synthetic oligonucleotide"
caccuugauguagaugaua

SEQ ID NO: 3192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuugauguagaugauatt

SEQ ID NO: 3193 - RNA, 19 nt, Artificial Sequence
  source: /note="Description of Artificial Sequence: Synthetic oligonucleotide"
uccacucccaaggugugug

SEQ ID NO: 3194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacucccaaggugugugtt

SEQ ID NO: 3195 - RNA, 19 nt, Artificial Sequence
  source: /note="Description of Artificial Sequence: Synthetic oligonucleotide"
cacacaccuugggagugga

SEQ ID NO: 3196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacacaccuugggaguggatt

SEQ ID NO: 3197 - RNA, 19 nt, Artificial Sequence
  source: /note="Description of Artificial Sequence: Synthetic oligonucleotide"
ucccaaggugugugucacc

SEQ ID NO: 3198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccaaggugugugucacctt

SEQ ID NO: 3199 - RNA, 19 nt, Artificial Sequence
  source: /note="Description of Artificial Sequence: Synthetic oligonucleotide"
ggugacacacaccuuggga

SEQ ID NO: 3200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugacacacaccuugggatt

SEQ ID NO: 3201 - RNA, 19 nt, Artificial Sequence
  source: /note="Description of Artificial Sequence: Synthetic oligonucleotide"
cccaaggugugugucaccg

SEQ ID NO: 3202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaaggugugugucaccgtt

SEQ ID NO: 3203 - RNA, 19 nt, Artificial Sequence
  source: /note="Description of Artificial Sequence: Synthetic oligonucleotide"
cggugacacacaccuuggg

SEQ ID NO: 3204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggugacacacaccuugggtt

SEQ ID NO: 3205 - RNA, 19 nt, Artificial Sequence
  source: /note="Description of Artificial Sequence: Synthetic oligonucleotide"
aucaagccccagaauuugc

SEQ ID NO: 3206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagccccagaauuugctt

SEQ ID NO: 3207 - RNA, 19 nt, Artificial Sequence
  source: /note="Description of Artificial Sequence: Synthetic oligonucleotide"
gcaaauucuggggcuugau

SEQ ID NO: 3208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaauucuggggcuugautt

SEQ ID NO: 3209 - RNA, 19 nt, Artificial Sequence
  source: /note="Description of Artificial Sequence: Synthetic oligonucleotide"
ucaagccccagaauuugcu

SEQ ID NO: 3210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagccccagaauuugcutt

SEQ ID NO: 3211 - RNA, 19 nt, Artificial Sequence
  source: /note="Description of Artificial Sequence: Synthetic oligonucleotide"
agcaaauucuggggcuuga

SEQ ID NO: 3212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaaauucuggggcuugatt

SEQ ID NO: 3213 - RNA, 19 nt, Artificial Sequence
  source: /note="Description of Artificial Sequence: Synthetic oligonucleotide"
caagccccagaauuugcuu

SEQ ID NO: 3214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagccccagaauuugcuutt

SEQ ID NO: 3215 - RNA, 19 nt, Artificial Sequence
  source: /note="Description of Artificial Sequence: Synthetic oligonucleotide"
aagcaaauucuggggcuug

SEQ ID NO: 3216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcaaauucuggggcuugtt

SEQ ID NO: 3217 - RNA, 19 nt, Artificial Sequence
  source: /note="Description of Artificial Sequence: Synthetic oligonucleotide"
ugacacugcuguccucaag

SEQ ID NO: 3218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacacugcuguccucaagtt

SEQ ID NO: 3219 - RNA, 19 nt, Artificial Sequence
  source: /note="Description of Artificial Sequence: Synthetic oligonucleotide"
cuugaggacagcaguguca

SEQ ID NO: 3220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaggacagcagugucatt

SEQ ID NO: 3221 - RNA, 19 nt, Artificial Sequence
  source: /note="Description of Artificial Sequence: Synthetic oligonucleotide"
ccagaacucaucuuuggag

SEQ ID NO: 3222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaacucaucuuuggagtt

SEQ ID NO: 3223 - RNA, 19 nt, Artificial Sequence
  source: /note="Description of Artificial Sequence: Synthetic oligonucleotide"
cuccaaagaugaguucugg

SEQ ID NO: 3224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccaaagaugaguucuggtt

SEQ ID NO: 3225 - RNA, 19 nt, Artificial Sequence
  source: /note="Description of Artificial Sequence: Synthetic oligonucleotide"
aacucaucuuuggagccac

SEQ ID NO: 3226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacucaucuuuggagccactt

SEQ ID NO: 3227 - RNA, 19 nt, Artificial Sequence
  source: /note="Description of Artificial Sequence: Synthetic oligonucleotide"
guggcuccaaagaugaguu

SEQ ID NO: 3228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcuccaaagaugaguutt

SEQ ID NO: 3229 - RNA, 19 nt, Artificial Sequence
  source: /note="Description of Artificial Sequence: Synthetic oligonucleotide"
ucuuuggagccacagauua

SEQ ID NO: 3230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuuggagccacagauuatt

SEQ ID NO: 3231 - RNA, 19 nt, Artificial Sequence
  source: /note="Description of Artificial Sequence: Synthetic oligonucleotide"
uaaucuguggcuccaaaga

SEQ ID NO: 3232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaucuguggcuccaaagatt

SEQ ID NO: 3233 - RNA, 19 nt, Artificial Sequence
  source: /note="Description of Artificial Sequence: Synthetic oligonucleotide"
gagccacagauuacaccuc

SEQ ID NO: 3234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccacagauuacaccuctt

SEQ ID NO: 3235 - RNA, 19 nt, Artificial Sequence
  source: /note="Description of Artificial Sequence: Synthetic oligonucleotide"
gagguguaaucuguggcuc

SEQ ID NO: 3236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagguguaaucuguggcuctt

SEQ ID NO: 3237 - RNA, 19 nt, Artificial Sequence
  source: /note="Description of Artificial Sequence: Synthetic oligonucleotide"
ggcuggcuguguacuugcu

SEQ ID NO: 3238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuggcuguguacuugcutt

SEQ ID NO: 3239 - RNA, 19 nt, Artificial Sequence
  source: /note="Description of Artificial Sequence: Synthetic oligonucleotide"
agcaaguacacagccagcc

SEQ ID NO: 3240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaaguacacagccagcctt

SEQ ID NO: 3241 - RNA, 19 nt, Artificial Sequence
  source: /note="Description of Artificial Sequence: Synthetic oligonucleotide"
acuugcugagcuacuucuc

SEQ ID NO: 3242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugcugagcuacuucuctt

SEQ ID NO: 3243 - RNA, 19 nt, Artificial Sequence
  source: /note="Description of Artificial Sequence: Synthetic oligonucleotide"
gagaaguagcucagcaagu

SEQ ID NO: 3244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaaguagcucagcaagutt

SEQ ID NO: 3245 - RNA, 19 nt, Artificial Sequence
  source: /note="Description of Artificial Sequence: Synthetic oligonucleotide"
ucggccagcccaucuuccc

SEQ ID NO: 3246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggccagcccaucuuccctt

SEQ ID NO: 3247 - RNA, 19 nt, Artificial Sequence
  source: /note="Description of Artificial Sequence: Synthetic oligonucleotide"
gggaagaugggcuggccga

SEQ ID NO: 3248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagaugggcuggccgatt

SEQ ID NO: 3249 - RNA, 19 nt, Artificial Sequence
  source: /note="Description of Artificial Sequence: Synthetic oligonucleotide"
ggccagcccaucuucccug

SEQ ID NO: 3250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccagcccaucuucccugtt

SEQ ID NO: 3251 - RNA, 19 nt, Artificial Sequence
  source: /note="Description of Artificial Sequence: Synthetic oligonucleotide"
cagggaagaugggcuggcc

SEQ ID NO: 3252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggaagaugggcuggcctt

SEQ ID NO: 3253 - RNA, 19 nt, Artificial Sequence
  source: /note="Description of Artificial Sequence: Synthetic oligonucleotide"
cagcccaucuucccugggg

SEQ ID NO: 3254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccaucuucccuggggtt

SEQ ID NO: 3255 - RNA, 19 nt, Artificial Sequence
  source: /note="Description of Artificial Sequence: Synthetic oligonucleotide"
ccccagggaagaugggcug

SEQ ID NO: 3256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagggaagaugggcugtt

SEQ ID NO: 3257 - RNA, 19 nt, Artificial Sequence
  source: /note="Description of Artificial Sequence: Synthetic oligonucleotide"
caucuucccuggggacagu

SEQ ID NO: 3258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuucccuggggacagutt

SEQ ID NO: 3259 - RNA, 19 nt, Artificial Sequence
  source: /note="Description of Artificial Sequence: Synthetic oligonucleotide"
acuguccccagggaagaug

SEQ ID NO: 3260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguccccagggaagaugtt

SEQ ID NO: 3261 - RNA, 19 nt, Artificial Sequence
  source: /note="Description of Artificial Sequence: Synthetic oligonucleotide"
ucccuggggacaguggggu

SEQ ID NO: 3262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuggggacaguggggutt

SEQ ID NO: 3263 - RNA, 19 nt, Artificial Sequence
  source: /note="Description of Artificial Sequence: Synthetic oligonucleotide"
accccacuguccccaggga

SEQ ID NO: 3264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accccacuguccccagggatt

SEQ ID NO: 3265 - RNA, 19 nt, Artificial Sequence
  source: /note="Description of Artificial Sequence: Synthetic oligonucleotide"
aagcucacccuuggacaaa

SEQ ID NO: 3266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcucacccuuggacaaatt

SEQ ID NO: 3267 - RNA, 19 nt, Artificial Sequence
  source: /note="Description of Artificial Sequence: Synthetic oligonucleotide"
uuuguccaagggugagcuu

SEQ ID NO: 3268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuguccaagggugagcuutt

SEQ ID NO: 3269 - RNA, 19 nt, Artificial Sequence
  source: /note="Description of Artificial Sequence: Synthetic oligonucleotide"
aaaucuucaaagacaccac

SEQ ID NO: 3270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaucuucaaagacaccactt

SEQ ID NO: 3271 - RNA, 19 nt, Artificial Sequence
  source: /note="Description of Artificial Sequence: Synthetic oligonucleotide"
guggugucuuugaagauuu

SEQ ID NO: 3272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggugucuuugaagauuutt

SEQ ID NO: 3273 - RNA, 19 nt, Artificial Sequence
  source: /note="Description of Artificial Sequence: Synthetic oligonucleotide"
aaucuucaaagacaccacc

SEQ ID NO: 3274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucuucaaagacaccacctt

SEQ ID NO: 3275 - RNA, 19 nt, Artificial Sequence
  source: /note="Description of Artificial Sequence: Synthetic oligonucleotide"
gguggugucuuugaagauu

SEQ ID NO: 3276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggugucuuugaagauutt

SEQ ID NO: 3277 - RNA, 19 nt, Artificial Sequence
  source: /note="Description of Artificial Sequence: Synthetic oligonucleotide"
ucaaagacaccaccugagg

SEQ ID NO: 3278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaagacaccaccugaggtt

SEQ ID NO: 3279 - RNA, 19 nt, Artificial Sequence
  source: /note="Description of Artificial Sequence: Synthetic oligonucleotide"
ccucagguggugucuuuga

SEQ ID NO: 3280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucagguggugucuuugatt

SEQ ID NO: 3281 - RNA, 19 nt, Artificial Sequence
  source: /note="Description of Artificial Sequence: Synthetic oligonucleotide"
caccaccugaggccauugc

SEQ ID NO: 3282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaccugaggccauugctt

SEQ ID NO: 3283 - RNA, 19 nt, Artificial Sequence
  source: /note="Description of Artificial Sequence: Synthetic oligonucleotide"
gcaauggccucagguggug

SEQ ID NO: 3284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaauggccucagguggugtt

SEQ ID NO: 3285 - RNA, 19 nt, Artificial Sequence
  source: /note="Description of Artificial Sequence: Synthetic oligonucleotide"
cugcucuagccuacuggag

SEQ ID NO: 3286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcucuagccuacuggagtt

SEQ ID NO: 3287 - RNA, 19 nt, Artificial Sequence
  source: /note="Description of Artificial Sequence: Synthetic oligonucleotide"
cuccaguaggcuagagcag

SEQ ID NO: 3288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccaguaggcuagagcagtt

SEQ ID NO: 3289 - RNA, 19 nt, Artificial Sequence
  source: /note="Description of Artificial Sequence: Synthetic oligonucleotide"
ggagcccagcuccccaacg

SEQ ID NO: 3290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcccagcuccccaacgtt

SEQ ID NO: 3291 - RNA, 19 nt, Artificial Sequence
  source: /note="Description of Artificial Sequence: Synthetic oligonucleotide"
cguuggggagcugggcucc

SEQ ID NO: 3292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguuggggagcugggcucctt

SEQ ID NO: 3293 - RNA, 19 nt, Artificial Sequence
  source: /note="Description of Artificial Sequence: Synthetic oligonucleotide"
accgcccgcuucccccccu

SEQ ID NO: 3294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcccgcuucccccccutt

SEQ ID NO: 3295 - RNA, 19 nt, Artificial Sequence
  source: /note="Description of Artificial Sequence: Synthetic oligonucleotide"
agggggggaagcgggcggu

SEQ ID NO: 3296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggggggaagcgggcggutt

SEQ ID NO: 3297 - RNA, 19 nt, Artificial Sequence
  source: /note="Description of Artificial Sequence: Synthetic oligonucleotide"
uggugaacuguccauccaa

SEQ ID NO: 3298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugaacuguccauccaatt

SEQ ID NO: 3299 - RNA, 19 nt, Artificial Sequence
  source: /note="Description of Artificial Sequence: Synthetic oligonucleotide"
uuggauggacaguucacca

SEQ ID NO: 3300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggauggacaguucaccatt

SEQ ID NO: 3301 - RNA, 19 nt, Artificial Sequence
  source: /note="Description of Artificial Sequence: Synthetic oligonucleotide"
ccaaccaucucucaaugcc

SEQ ID NO: 3302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaccaucucucaaugcctt

SEQ ID NO: 3303 - RNA, 19 nt, Artificial Sequence
  source: /note="Description of Artificial Sequence: Synthetic oligonucleotide"
ggcauugagagaugguugg

SEQ ID NO: 3304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcauugagagaugguuggtt

SEQ ID NO: 3305 - RNA, 19 nt, Artificial Sequence
  source: /note="Description of Artificial Sequence: Synthetic oligonucleotide"
gcccugcuucuccccucac

SEQ ID NO: 3306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccugcuucuccccucactt

SEQ ID NO: 3307 - RNA, 19 nt, Artificial Sequence
  source: /note="Description of Artificial Sequence: Synthetic oligonucleotide"
gugaggggagaagcagggc

SEQ ID NO: 3308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaggggagaagcagggctt

SEQ ID NO: 3309 - RNA, 19 nt, Artificial Sequence
  source: /note="Description of Artificial Sequence: Synthetic oligonucleotide"
cccugcuucuccccucacc

SEQ ID NO: 3310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugcuucuccccucacctt

SEQ ID NO: 3311 - RNA, 19 nt, Artificial Sequence
  source: /note="Description of Artificial Sequence: Synthetic oligonucleotide"
ggugaggggagaagcaggg

SEQ ID NO: 3312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugaggggagaagcagggtt

SEQ ID NO: 3313 - RNA, 19 nt, Artificial Sequence
  source: /note="Description of Artificial Sequence: Synthetic oligonucleotide"
ccugcuucuccccucacca

SEQ ID NO: 3314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugcuucuccccucaccatt

SEQ ID NO: 3315 - RNA, 19 nt, Artificial Sequence
  source: /note="Description of Artificial Sequence: Synthetic oligonucleotide"
uggugaggggagaagcagg

SEQ ID NO: 3316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugaggggagaagcaggtt

SEQ ID NO: 3317 - RNA, 19 nt, Artificial Sequence
  source: /note="Description of Artificial Sequence: Synthetic oligonucleotide"
cugcuucuccccucaccac

SEQ ID NO: 3318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuucuccccucaccactt

SEQ ID NO: 3319 - RNA, 19 nt, Artificial Sequence
  source: /note="Description of Artificial Sequence: Synthetic oligonucleotide"
guggugaggggagaagcag

SEQ ID NO: 3320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggugaggggagaagcagtt

SEQ ID NO: 3321 - RNA, 19 nt, Artificial Sequence
  source: /note="Description of Artificial Sequence: Synthetic oligonucleotide"
uucuccccucaccacuucc

SEQ ID NO: 3322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuccccucaccacuucctt

SEQ ID NO: 3323 - RNA, 19 nt, Artificial Sequence
  source: /note="Description of Artificial Sequence: Synthetic oligonucleotide"
ggaaguggugaggggagaa

SEQ ID NO: 3324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaguggugaggggagaatt

SEQ ID NO: 3325 - RNA, 19 nt, Artificial Sequence
  source: /note="Description of Artificial Sequence: Synthetic oligonucleotide"
caccacuuccuacaaccca

SEQ ID NO: 3326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccacuuccuacaacccatt

SEQ ID NO: 3327 - RNA, 19 nt, Artificial Sequence
  source: /note="Description of Artificial Sequence: Synthetic oligonucleotide"
uggguuguaggaaguggug

SEQ ID NO: 3328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggguuguaggaaguggugtt

SEQ ID NO: 3329 - RNA, 19 nt, Artificial Sequence
  source: /note="Description of Artificial Sequence: Synthetic oligonucleotide"
cccauccucacaagcuuua

SEQ ID NO: 3330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccauccucacaagcuuuatt

SEQ ID NO: 3331 - RNA, 19 nt, Artificial Sequence
  source: /note="Description of Artificial Sequence: Synthetic oligonucleotide"
uaaagcuugugaggauggg

SEQ ID NO: 3332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaagcuugugaggaugggtt

SEQ ID NO: 3333 - RNA, 19 nt, Artificial Sequence
  source: /note="Description of Artificial Sequence: Synthetic oligonucleotide"
aagcuuuaacugaagcuca

SEQ ID NO: 3334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuuuaacugaagcucatt

SEQ ID NO: 3335 - RNA, 19 nt, Artificial Sequence
  source: /note="Description of Artificial Sequence: Synthetic oligonucleotide"
ugagcuucaguuaaagcuu

SEQ ID NO: 3336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagcuucaguuaaagcuutt

SEQ ID NO: 3337 - RNA, 19 nt, Artificial Sequence
  source: /note="Description of Artificial Sequence: Synthetic oligonucleotide"
agcucagacuggccaagau

SEQ ID NO: 3338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucagacuggccaagautt

SEQ ID NO: 3339 - RNA, 19 nt, Artificial Sequence
  source: /note="Description of Artificial Sequence: Synthetic oligonucleotide"
aucuuggccagucugagcu

SEQ ID NO: 3340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuuggccagucugagcutt

SEQ ID NO: 3341 - RNA, 19 nt, Artificial Sequence
  source: /note="Description of Artificial Sequence: Synthetic oligonucleotide"
gcucagacuggccaagauu

SEQ ID NO: 3342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucagacuggccaagauutt

SEQ ID NO: 3343 - RNA, 19 nt, Artificial Sequence
  source: /note="Description of Artificial Sequence: Synthetic oligonucleotide"
aaucuuggccagucugagc

SEQ ID NO: 3344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucuuggccagucugagctt

SEQ ID NO: 3345 - RNA, 19 nt, Artificial Sequence
  source: /note="Description of Artificial Sequence: Synthetic oligonucleotide"
acuggccaagauuggcagc

SEQ ID NO: 3346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggccaagauuggcagctt

SEQ ID NO: 3347 - RNA, 19 nt, Artificial Sequence
  source: /note="Description of Artificial Sequence: Synthetic oligonucleotide"
gcugccaaucuuggccagu

SEQ ID NO: 3348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccaaucuuggccagutt

SEQ ID NO: 3349 - RNA, 19 nt, Artificial Sequence
  source: /note="Description of Artificial Sequence: Synthetic oligonucleotide"
caagauuggcagccaucug

SEQ ID NO: 3350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagauuggcagccaucugtt

SEQ ID NO: 3351 - RNA, 19 nt, Artificial Sequence
  source: /note="Description of Artificial Sequence: Synthetic oligonucleotide"
cagauggcugccaaucuug

SEQ ID NO: 3352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauggcugccaaucuugtt

SEQ ID NO: 3353 - RNA, 19 nt, Artificial Sequence
  source: /note="Description of Artificial Sequence: Synthetic oligonucleotide"
aagauuggcagccaucuga

SEQ ID NO: 3354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagauuggcagccaucugatt

SEQ ID NO: 3355 - RNA, 19 nt, Artificial Sequence
  source: /note="Description of Artificial Sequence: Synthetic oligonucleotide"
ucagauggcugccaaucuu

SEQ ID NO: 3356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagauggcugccaaucuutt

SEQ ID NO: 3357 - RNA, 19 nt, Artificial Sequence
  source: /note="Description of Artificial Sequence: Synthetic oligonucleotide"
cuagcucuuccugagggcc

SEQ ID NO: 3358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagcucuuccugagggcctt

SEQ ID NO: 3359 - RNA, 19 nt, Artificial Sequence
  source: /note="Description of Artificial Sequence: Synthetic oligonucleotide"
ggcccucaggaagagcuag

SEQ ID NO: 3360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccucaggaagagcuagtt

SEQ ID NO: 3361 - RNA, 19 nt, Artificial Sequence
  source: /note="Description of Artificial Sequence: Synthetic oligonucleotide"
cucuuccugagggccccac

SEQ ID NO: 3362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuuccugagggccccactt

SEQ ID NO: 3363 - RNA, 19 nt, Artificial Sequence
  source: /note="Description of Artificial Sequence: Synthetic oligonucleotide"
guggggcccucaggaagag

SEQ ID NO: 3364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggggcccucaggaagagtt

SEQ ID NO: 3365 - RNA, 19 nt, Artificial Sequence
  source: /note="Description of Artificial Sequence: Synthetic oligonucleotide"
ucuuccugagggccccacc

SEQ ID NO: 3366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuccugagggccccacctt

SEQ ID NO: 3367 - RNA, 19 nt, Artificial Sequence
  source: /note="Description of Artificial Sequence: Synthetic oligonucleotide"
gguggggcccucaggaaga

SEQ ID NO: 3368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggggcccucaggaagatt

SEQ ID NO: 3369 - RNA, 19 nt, Artificial Sequence
  source: /note="Description of Artificial Sequence: Synthetic oligonucleotide"
uaggccucccucagcagcc

SEQ ID NO: 3370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggccucccucagcagcctt

SEQ ID NO: 3371 - RNA, 19 nt, Artificial Sequence
  source: /note="Description of Artificial Sequence: Synthetic oligonucleotide"
ggcugcugagggaggccua

SEQ ID NO: 3372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugcugagggaggccuatt

SEQ ID NO: 3373 - RNA, 19 nt, Artificial Sequence
  source: /note="Description of Artificial Sequence: Synthetic oligonucleotide"
aggccucccucagcagccu

SEQ ID NO: 3374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccucccucagcagccutt

SEQ ID NO: 3375 - RNA, 19 nt, Artificial Sequence
  source: /note="Description of Artificial Sequence: Synthetic oligonucleotide"
aggcugcugagggaggccu

SEQ ID NO: 3376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcugcugagggaggccutt

SEQ ID NO: 3377 - RNA, 19 nt, Artificial Sequence
  source: /note="Description of Artificial Sequence: Synthetic oligonucleotide"
ggccucccucagcagccua

SEQ ID NO: 3378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccucccucagcagccuatt

SEQ ID NO: 3379 - RNA, 19 nt, Artificial Sequence
  source: /note="Description of Artificial Sequence: Synthetic oligonucleotide"
uaggcugcugagggaggcc

SEQ ID NO: 3380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggcugcugagggaggcctt

SEQ ID NO: 3381 - RNA, 19 nt, Artificial Sequence
  source: /note="Description of Artificial Sequence: Synthetic oligonucleotide"
gccucccucagcagccuaa

SEQ ID NO: 3382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucccucagcagccuaatt

SEQ ID NO: 3383 - RNA, 19 nt, Artificial Sequence
  source: /note="Description of Artificial Sequence: Synthetic oligonucleotide"
uuaggcugcugagggaggc

SEQ ID NO: 3384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaggcugcugagggaggctt

SEQ ID NO: 3385 - RNA, 19 nt, Artificial Sequence
  source: /note="Description of Artificial Sequence: Synthetic oligonucleotide"
cccucagcagccuaaccuc

SEQ ID NO: 3386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucagcagccuaaccuctt

SEQ ID NO: 3387 - RNA, 19 nt, Artificial Sequence
  source: /note="Description of Artificial Sequence: Synthetic oligonucleotide"
gagguuaggcugcugaggg

SEQ ID NO: 3388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagguuaggcugcugagggtt

SEQ ID NO: 3389 - RNA, 19 nt, Artificial Sequence
  source: /note="Description of Artificial Sequence: Synthetic oligonucleotide"
agaggauuuuaacuguuug

SEQ ID NO: 3390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggauuuuaacuguuugtt

SEQ ID NO: 3391 - RNA, 19 nt, Artificial Sequence
  source: /note="Description of Artificial Sequence: Synthetic oligonucleotide"
caaacaguuaaaauccucu

SEQ ID NO: 3392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaacaguuaaaauccucutt

SEQ ID NO: 3393 - RNA, 19 nt, Artificial Sequence
  source: /note="Description of Artificial Sequence: Synthetic oligonucleotide"
aggggagaaaaggaaggac

SEQ ID NO: 3394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggagaaaaggaaggactt

SEQ ID NO: 3395 - RNA, 19 nt, Artificial Sequence
  source: /note="Description of Artificial Sequence: Synthetic oligonucleotide"
guccuuccuuuucuccccu

SEQ ID NO: 3396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuuccuuuucuccccutt

SEQ ID NO: 3397 - RNA, 19 nt, Artificial Sequence
  source: /note="Description of Artificial Sequence: Synthetic oligonucleotide"
gggagaaaaggaaggacgg

SEQ ID NO: 3398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagaaaaggaaggacggtt

SEQ ID NO: 3399 - RNA, 19 nt, Artificial Sequence
  source: /note="Description of Artificial Sequence: Synthetic oligonucleotide"
ccguccuuccuuuucuccc

SEQ ID NO: 3400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccguccuuccuuuucuccctt

SEQ ID NO: 3401 - RNA, 19 nt, Artificial Sequence
  source: /note="Description of Artificial Sequence: Synthetic oligonucleotide"
gaaaaggaaggacgggguu

SEQ ID NO: 3402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaaggaaggacgggguutt

SEQ ID NO: 3403 - RNA, 19 nt, Artificial Sequence
  source: /note="Description of Artificial Sequence: Synthetic oligonucleotide"
aaccccguccuuccuuuuc

SEQ ID NO: 3404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccccguccuuccuuuuctt

SEQ ID NO: 3405 - RNA, 19 nt, Artificial Sequence
  source: /note="Description of Artificial Sequence: Synthetic oligonucleotide"
cccucccccaggcuaccac

SEQ ID NO: 3406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucccccaggcuaccactt

SEQ ID NO: 3407 - RNA, 19 nt, Artificial Sequence
  source: /note="Description of Artificial Sequence: Synthetic oligonucleotide"
gugguagccugggggaggg

SEQ ID NO: 3408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguagccugggggagggtt

SEQ ID NO: 3409 - RNA, 19 nt, Artificial Sequence
  source: /note="Description of Artificial Sequence: Synthetic oligonucleotide"
ccucccccaggcuaccacu

SEQ ID NO: 3410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucccccaggcuaccacutt

SEQ ID NO: 3411 - RNA, 19 nt, Artificial Sequence
  source: /note="Description of Artificial Sequence: Synthetic oligonucleotide"
agugguagccugggggagg

SEQ ID NO: 3412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugguagccugggggaggtt

SEQ ID NO: 3413 - RNA, 19 nt, Artificial Sequence
  source: /note="Description of Artificial Sequence: Synthetic oligonucleotide"
ccaggcuaccacuccuucc

SEQ ID NO: 3414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggcuaccacuccuucctt

SEQ ID NO: 3415 - RNA, 19 nt, Artificial Sequence
  source: /note="Description of Artificial Sequence: Synthetic oligonucleotide"
ggaaggagugguagccugg

SEQ ID NO: 3416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaggagugguagccuggtt

SEQ ID NO: 3417 - RNA, 19 nt, Artificial Sequence
  source: /note="Description of Artificial Sequence: Synthetic oligonucleotide"
caggcuaccacuccuuccc

SEQ ID NO: 3418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcuaccacuccuuccctt

SEQ ID NO: 3419 - RNA, 19 nt, Artificial Sequence
  source: /note="Description of Artificial Sequence: Synthetic oligonucleotide"
gggaaggagugguagccug

SEQ ID NO: 3420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaaggagugguagccugtt

SEQ ID NO: 3421 - RNA, 19 nt, Artificial Sequence
  source: /note="Description of Artificial Sequence: Synthetic oligonucleotide"
cuaccacuccuucccuccc

SEQ ID NO: 3422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccacuccuucccuccctt

SEQ ID NO: 3423 - RNA, 19 nt, Artificial Sequence
  source: /note="Description of Artificial Sequence: Synthetic oligonucleotide"
gggagggaaggagugguag

SEQ ID NO: 3424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagggaaggagugguagtt

SEQ ID NO: 3425 - RNA, 19 nt, Artificial Sequence
  source: /note="Description of Artificial Sequence: Synthetic oligonucleotide"
uaccacuccuucccucccc

SEQ ID NO: 3426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccacuccuucccucccctt

SEQ ID NO: 3427 - RNA, 19 nt, Artificial Sequence
  source: /note="Description of Artificial Sequence: Synthetic oligonucleotide"
ggggagggaaggaguggua

SEQ ID NO: 3428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagggaaggagugguatt

SEQ ID NO: 3429 - RNA, 19 nt, Artificial Sequence
  source: /note="Description of Artificial Sequence: Synthetic oligonucleotide"
ccuucccucccccccucuc

SEQ ID NO: 3430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucccucccccccucuctt

SEQ ID NO: 3431 - RNA, 19 nt, Artificial Sequence
  source: /note="Description of Artificial Sequence: Synthetic oligonucleotide"
gagagggggggagggaagg

SEQ ID NO: 3432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagggggggagggaaggtt

SEQ ID NO: 3433 - RNA, 19 nt, Artificial Sequence
  source: /note="Description of Artificial Sequence: Synthetic oligonucleotide"
ccuggcccccuggguguaa

SEQ ID NO: 3434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggcccccuggguguaatt

SEQ ID NO: 3435 - RNA, 19 nt, Artificial Sequence
  source: /note="Description of Artificial Sequence: Synthetic oligonucleotide"
uuacacccagggggccagg

SEQ ID NO: 3436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacacccagggggccaggtt

SEQ ID NO: 3437 - RNA, 19 nt, Artificial Sequence
  source: /note="Description of Artificial Sequence: Synthetic oligonucleotide"
cuggcccccuggguguaaa

SEQ ID NO: 3438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcccccuggguguaaatt

SEQ ID NO: 3439 - RNA, 19 nt, Artificial Sequence
  source: /note="Description of Artificial Sequence: Synthetic oligonucleotide"
uuuacacccagggggccag

SEQ ID NO: 3440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuacacccagggggccagtt

SEQ ID NO: 3441 - RNA, 19 nt, Artificial Sequence
  source: /note="Description of Artificial Sequence: Synthetic oligonucleotide"
aaauagauuguuauaauuu

SEQ ID NO: 3442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauagauuguuauaauuutt

SEQ ID NO: 3443 - RNA, 19 nt, Artificial Sequence
  source: /note="Description of Artificial Sequence: Synthetic oligonucleotide"
aaauuauaacaaucuauuu

SEQ ID NO: 3444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauuauaacaaucuauuutt

SEQ ID NO: 3445 - RNA, 19 nt, Artificial Sequence
  source: /note="Description of Artificial Sequence: Synthetic oligonucleotide"
uagauuguuauaauuuuuu

SEQ ID NO: 3446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagauuguuauaauuuuuutt

SEQ ID NO: 3447 - RNA, 19 nt, Artificial Sequence
  source: /note="Description of Artificial Sequence: Synthetic oligonucleotide"
aaaaaauuauaacaaucua

SEQ ID NO: 3448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaaauuauaacaaucuatt

SEQ ID NO: 3449 - RNA, 19 nt, Artificial Sequence
  source: /note="Description of Artificial Sequence: Synthetic oligonucleotide"
agauuguuauaauuuuuuc

SEQ ID NO: 3450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuguuauaauuuuuuctt

SEQ ID NO: 3451 - RNA, 19 nt, Artificial Sequence
  source: /note="Description of Artificial Sequence: Synthetic oligonucleotide"
gaaaaaauuauaacaaucu

SEQ ID NO: 3452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaaaauuauaacaaucutt

SEQ ID NO: 3453 - RNA, 19 nt, Artificial Sequence
  source: /note="Description of Artificial Sequence: Synthetic oligonucleotide"
gauuguuauaauuuuuucu

SEQ ID NO: 3454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuguuauaauuuuuucutt

SEQ ID NO: 3455 - RNA, 19 nt, Artificial Sequence
  source: /note="Description of Artificial Sequence: Synthetic oligonucleotide"
agaaaaaauuauaacaauc

SEQ ID NO: 3456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaaaauuauaacaauctt

SEQ ID NO: 3457 - RNA, 19 nt, Artificial Sequence
  source: /note="Description of Artificial Sequence: Synthetic oligonucleotide"
auuguuauaauuuuuucuu

SEQ ID NO: 3458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuguuauaauuuuuucuutt

SEQ ID NO: 3459 - RNA, 19 nt, Artificial Sequence
  source: /note="Description of Artificial Sequence: Synthetic oligonucleotide"
aagaaaaaauuauaacaau

SEQ ID NO: 3460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaaaaauuauaacaautt

SEQ ID NO: 3461 - RNA, 19 nt, Artificial Sequence
  source: /note="Description of Artificial Sequence: Synthetic oligonucleotide"
guuauaauuuuuucuuaaa

SEQ ID NO: 3462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuauaauuuuuucuuaaatt

SEQ ID NO: 3463 - RNA, 19 nt, Artificial Sequence
  source: /note="Description of Artificial Sequence: Synthetic oligonucleotide"
uuuaagaaaaaauuauaac

SEQ ID NO: 3464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaagaaaaaauuauaactt

SEQ ID NO: 3465 - RNA, 19 nt, Artificial Sequence
  source: /note="Description of Artificial Sequence: Synthetic oligonucleotide"
ucuuguccucugcucccaa

SEQ ID NO: 3466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuguccucugcucccaatt

SEQ ID NO: 3467 - RNA, 19 nt, Artificial Sequence
  source: /note="Description of Artificial Sequence: Synthetic oligonucleotide"
uugggagcagaggacaaga

SEQ ID NO: 3468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggagcagaggacaagatt

SEQ ID NO: 3469 - RNA, 19 nt, Artificial Sequence
  source: /note="Description of Artificial Sequence: Synthetic oligonucleotide"
cuuguccucugcucccaag

SEQ ID NO: 3470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguccucugcucccaagtt

SEQ ID NO: 3471 - RNA, 19 nt, Artificial Sequence
  source: /note="Description of Artificial Sequence: Synthetic oligonucleotide"
cuugggagcagaggacaag

SEQ ID NO: 3472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugggagcagaggacaagtt

SEQ ID NO: 3473 - RNA, 19 nt, Artificial Sequence
  source: /note="Description of Artificial Sequence: Synthetic oligonucleotide"
cucccaaggcuuccucccu

SEQ ID NO: 3474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccaaggcuuccucccutt

SEQ ID NO: 3475 - RNA, 19 nt, Artificial Sequence
  source: /note="Description of Artificial Sequence: Synthetic oligonucleotide"
agggaggaagccuugggag

SEQ ID NO: 3476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaggaagccuugggagtt

SEQ ID NO: 3477 - RNA, 19 nt, Artificial Sequence
  source: /note="Description of Artificial Sequence: Synthetic oligonucleotide"
ucccaaggcuuccucccuc

SEQ ID NO: 3478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccaaggcuuccucccuctt

SEQ ID NO: 3479 - RNA, 19 nt, Artificial Sequence
  source: /note="Description of Artificial Sequence: Synthetic oligonucleotide"
gagggaggaagccuuggga

SEQ ID NO: 3480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaggaagccuugggatt

SEQ ID NO: 3481 - RNA, 19 nt, Artificial Sequence
  source: /note="Description of Artificial Sequence: Synthetic oligonucleotide"
caaggcuuccucccucucc

SEQ ID NO: 3482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggcuuccucccucucctt

SEQ ID NO: 3483 - RNA, 19 nt, Artificial Sequence
  source: /note="Description of Artificial Sequence: Synthetic oligonucleotide"
ggagagggaggaagccuug

SEQ ID NO: 3484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagagggaggaagccuugtt

SEQ ID NO: 3485 - RNA, 19 nt, Artificial Sequence
  source: /note="Description of Artificial Sequence: Synthetic oligonucleotide"
aaggcuuccucccucuccc

SEQ ID NO: 3486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcuuccucccucuccctt

SEQ ID NO: 3487 - RNA, 19 nt, Artificial Sequence
  source: /note="Description of Artificial Sequence: Synthetic oligonucleotide"
gggagagggaggaagccuu

SEQ ID NO: 3488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagagggaggaagccuutt

SEQ ID NO: 3489 - RNA, 19 nt, Artificial Sequence
  source: /note="Description of Artificial Sequence: Synthetic oligonucleotide"
cucuccccauccuggaagg

SEQ ID NO: 3490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuccccauccuggaaggtt

SEQ ID NO: 3491 - RNA, 19 nt, Artificial Sequence
  source: /note="Description of Artificial Sequence: Synthetic oligonucleotide"
ccuuccaggauggggagag

SEQ ID NO: 3492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuccaggauggggagagtt

SEQ ID NO: 3493 - RNA, 19 nt, Artificial Sequence
  source: /note="Description of Artificial Sequence: Synthetic oligonucleotide"
ccccauccuggaaggaggg

SEQ ID NO: 3494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccauccuggaaggagggtt

SEQ ID NO: 3495 - RNA, 19 nt, Artificial Sequence
  source: /note="Description of Artificial Sequence: Synthetic oligonucleotide"
cccuccuuccaggaugggg

SEQ ID NO: 3496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuccuuccaggauggggtt

SEQ ID NO: 3497 - RNA, 19 nt, Artificial Sequence
  source: /note="Description of Artificial Sequence: Synthetic oligonucleotide"
ccauccuggaaggagggga

SEQ ID NO: 3498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauccuggaaggaggggatt

SEQ ID NO: 3499 - RNA, 19 nt, Artificial Sequence
  source: /note="Description of Artificial Sequence: Synthetic oligonucleotide"
uccccuccuuccaggaugg

SEQ ID NO: 3500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccuccuuccaggauggtt

SEQ ID NO: 3501 - RNA, 19 nt, Artificial Sequence
  source: /note="Description of Artificial Sequence: Synthetic oligonucleotide"
ccuggaaggaggggaguag

SEQ ID NO: 3502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggaaggaggggaguagtt

SEQ ID NO: 3503 - RNA, 19 nt, Artificial Sequence
  source: /note="Description of Artificial Sequence: Synthetic oligonucleotide"
cuacuccccuccuuccagg

SEQ ID NO: 3504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacuccccuccuuccaggtt

SEQ ID NO: 3505 - RNA, 19 nt, Artificial Sequence
  source: /note="Description of Artificial Sequence: Synthetic oligonucleotide"
aaggaggggaguagagaga

SEQ ID NO: 3506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggaggggaguagagagatt

SEQ ID NO: 3507 - RNA, 19 nt, Artificial Sequence
  source: /note="Description of Artificial Sequence: Synthetic oligonucleotide"
ucucucuacuccccuccuu

SEQ ID NO: 3508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucucuacuccccuccuutt

SEQ ID NO: 3509 - RNA, 19 nt, Artificial Sequence
  source: /note="Description of Artificial Sequence: Synthetic oligonucleotide"
gguuugccuguguacagac

SEQ ID NO: 3510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuugccuguguacagactt

SEQ ID NO: 3511 - RNA, 19 nt, Artificial Sequence
  source: /note="Description of Artificial Sequence: Synthetic oligonucleotide"
gucuguacacaggcaaacc

SEQ ID NO: 3512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuguacacaggcaaacctt

SEQ ID NO: 3513 - RNA, 19 nt, Artificial Sequence
  source: /note="Description of Artificial Sequence: Synthetic oligonucleotide"
guacagaccucuguucaau

SEQ ID NO: 3514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacagaccucuguucaautt

SEQ ID NO: 3515 - RNA, 19 nt, Artificial Sequence
  source: /note="Description of Artificial Sequence: Synthetic oligonucleotide"
auugaacagaggucuguac

SEQ ID NO: 3516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugaacagaggucuguactt

SEQ ID NO: 3517 - RNA, 19 nt, Artificial Sequence
  source: /note="Description of Artificial Sequence: Synthetic oligonucleotide"
ucaauaaauuauuggcaug

SEQ ID NO: 3518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaauaaauuauuggcaugtt

SEQ ID NO: 3519 - RNA, 19 nt, Artificial Sequence
  source: /note="Description of Artificial Sequence: Synthetic oligonucleotide"
caugccaauaauuuauuga

SEQ ID NO: 3520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugccaauaauuuauugatt

SEQ ID NO: 3521 - RNA, 19 nt, Artificial Sequence
  source: /note="Description of Artificial Sequence: Synthetic oligonucleotide"
uggugacaacgaagccgac

SEQ ID NO: 3522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugacaacgaagccgactt

SEQ ID NO: 3523 - RNA, 19 nt, Artificial Sequence
  source: /note="Description of Artificial Sequence: Synthetic oligonucleotide"
gucggcuucguugucacca

SEQ ID NO: 3524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucggcuucguugucaccatt

SEQ ID NO: 3525 - RNA, 19 nt, Artificial Sequence
  source: /note="Description of Artificial Sequence: Synthetic oligonucleotide"
gcgggggcagcccaggcag

SEQ ID NO: 3526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggggcagcccaggcagtt

SEQ ID NO: 3527 - RNA, 19 nt, Artificial Sequence
  source: /note="Description of Artificial Sequence: Synthetic oligonucleotide"
cugccugggcugcccccgc

SEQ ID NO: 3528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccugggcugcccccgctt

SEQ ID NO: 3529 - RNA, 19 nt, Artificial Sequence
  source: /note="Description of Artificial Sequence: Synthetic oligonucleotide"
agcuccggggguggcccca

SEQ ID NO: 3530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuccggggguggccccatt

SEQ ID NO: 3531 - RNA, 19 nt, Artificial Sequence
  source: /note="Description of Artificial Sequence: Synthetic oligonucleotide"
uggggccacccccggagcu

SEQ ID NO: 3532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggccacccccggagcutt

SEQ ID NO: 3533 - RNA, 19 nt, Artificial Sequence
  source: /note="Description of Artificial Sequence: Synthetic oligonucleotide"
accaggcacggcuggcaga

SEQ ID NO: 3534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaggcacggcuggcagatt

SEQ ID NO: 3535 - RNA, 19 nt, Artificial Sequence
  source: /note="Description of Artificial Sequence: Synthetic oligonucleotide"
ucugccagccgugccuggu

SEQ ID NO: 3536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugccagccgugccuggutt

SEQ ID NO: 3537 - RNA, 19 nt, Artificial Sequence
  source: /note="Description of Artificial Sequence: Synthetic oligonucleotide"
agggaacugguggccauca

SEQ ID NO: 3538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaacugguggccaucatt

SEQ ID NO: 3539 - RNA, 19 nt, Artificial Sequence
  source: /note="Description of Artificial Sequence: Synthetic oligonucleotide"
ugauggccaccaguucccu

SEQ ID NO: 3540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauggccaccaguucccutt

SEQ ID NO: 3541 - RNA, 19 nt, Artificial Sequence
  source: /note="Description of Artificial Sequence: Synthetic oligonucleotide"
uacaucugcucucgguacu

SEQ ID NO: 3542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaucugcucucgguacutt

SEQ ID NO: 3543 - RNA, 19 nt, Artificial Sequence
  source: /note="Description of Artificial Sequence: Synthetic oligonucleotide"
aguaccgagagcagaugua

SEQ ID NO: 3544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaccgagagcagauguatt

SEQ ID NO: 3545 - RNA, 19 nt, Artificial Sequence
  source: /note="Description of Artificial Sequence: Synthetic oligonucleotide"
acaucugcucucgguacua

SEQ ID NO: 3546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucugcucucgguacuatt

SEQ ID NO: 3547 - RNA, 19 nt, Artificial Sequence
  source: /note="Description of Artificial Sequence: Synthetic oligonucleotide"
uaguaccgagagcagaugu

SEQ ID NO: 3548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguaccgagagcagaugutt

SEQ ID NO: 3549 - RNA, 19 nt, Artificial Sequence
  source: /note="Description of Artificial Sequence: Synthetic oligonucleotide"
cggcuggcuguguacuugc

SEQ ID NO: 3550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcuggcuguguacuugctt

SEQ ID NO: 3551 - RNA, 19 nt, Artificial Sequence
  source: /note="Description of Artificial Sequence: Synthetic oligonucleotide"
gcaaguacacagccagccg

SEQ ID NO: 3552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaguacacagccagccgtt

SEQ ID NO: 3553 - RNA, 19 nt, Artificial Sequence
  source: /note="Description of Artificial Sequence: Synthetic oligonucleotide"
ucaaggcucuccccacucg

SEQ ID NO: 3554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaggcucuccccacucgtt

SEQ ID NO: 3555 - RNA, 19 nt, Artificial Sequence
  source: /note="Description of Artificial Sequence: Synthetic oligonucleotide"
cgaguggggagagccuuga

SEQ ID NO: 3556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaguggggagagccuugatt

SEQ ID NO: 3557 - RNA, 19 nt, Artificial Sequence
  source: /note="Description of Artificial Sequence: Synthetic oligonucleotide"
gaccgcccgcuuccccccc

SEQ ID NO: 3558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccgcccgcuuccccccctt

SEQ ID NO: 3559 - RNA, 19 nt, Artificial Sequence
  source: /note="Description of Artificial Sequence: Synthetic oligonucleotide"
gggggggaagcgggcgguc

SEQ ID NO: 3560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggggaagcgggcgguctt

SEQ ID NO: 3561 - RNA, 19 nt, Artificial Sequence
  source: /note="Description of Artificial Sequence: Synthetic oligonucleotide"
cccuucccuggcccccugg

SEQ ID NO: 3562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuucccuggcccccuggtt

SEQ ID NO: 3563 - RNA, 19 nt, Artificial Sequence
  source: /note="Description of Artificial Sequence: Synthetic oligonucleotide"
ccagggggccagggaaggg

SEQ ID NO: 3564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggggccagggaagggtt

SEQ ID NO: 3565 - RNA, 19 nt, Artificial Sequence
  source: /note="Description of Artificial Sequence: Synthetic oligonucleotide"
ccuucccuggcccccuggg

SEQ ID NO: 3566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucccuggcccccugggtt

SEQ ID NO: 3567 - RNA, 19 nt, Artificial Sequence
  source: /note="Description of Artificial Sequence: Synthetic oligonucleotide"
cccagggggccagggaagg

SEQ ID NO: 3568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagggggccagggaaggtt

SEQ ID NO: 3569 - RNA, 19 nt, Artificial Sequence
  source: /note="Description of Artificial Sequence: Synthetic oligonucleotide"
cuucccuggcccccugggu

SEQ ID NO: 3570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccuggcccccugggutt

SEQ ID NO: 3571 - RNA, 19 nt, Artificial Sequence
  source: /note="Description of Artificial Sequence: Synthetic oligonucleotide"
acccagggggccagggaag

SEQ ID NO: 3572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccagggggccagggaagtt

SEQ ID NO: 3573 - RNA, 19 nt, Artificial Sequence
  source: /note="Description of Artificial Sequence: Synthetic oligonucleotide"
cuccccauccuggaaggag

SEQ ID NO: 3574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccauccuggaaggagtt

SEQ ID NO: 3575 - RNA, 19 nt, Artificial Sequence
  source: /note="Description of Artificial Sequence: Synthetic oligonucleotide"
cuccuuccaggauggggag

SEQ ID NO: 3576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuuccaggauggggagtt

SEQ ID NO: 3577 - RNA, 19 nt, Artificial Sequence
  source: /note="Description of Artificial Sequence: Synthetic oligonucleotide"
uccccauccuggaaggagg

SEQ ID NO: 3578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccauccuggaaggaggtt

SEQ ID NO: 3579 - RNA, 19 nt, Artificial Sequence
  source: /note="Description of Artificial Sequence: Synthetic oligonucleotide"
ccuccuuccaggaugggga

SEQ ID NO: 3580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccuuccaggauggggatt

SEQ ID NO: 3581 - RNA, 19 nt, Artificial Sequence
  source: /note="Description of Artificial Sequence: Synthetic oligonucleotide"
ucuagccuacuggaguaca

SEQ ID NO: 3582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuagccuacuggaguacatt

SEQ ID NO: 3583 - RNA, 19 nt, Artificial Sequence
  source: /note="Description of Artificial Sequence: Synthetic oligonucleotide"
uguacuccaguaggcuaga

SEQ ID NO: 3584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacuccaguaggcuagatt

SEQ ID NO: 3585 - RNA, 19 nt, Artificial Sequence
  source: /note="Description of Artificial Sequence: Synthetic oligonucleotide"
gcgucagucggggcuaugg

SEQ ID NO: 3586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgucagucggggcuauggtt

SEQ ID NO: 3587 - RNA, 19 nt, Artificial Sequence
  source: /note="Description of Artificial Sequence: Synthetic oligonucleotide"
ccauagccccgacugacgc

SEQ ID NO: 3588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauagccccgacugacgctt

SEQ ID NO: 3589 - RNA, 19 nt, Artificial Sequence
  source: /note="Description of Artificial Sequence: Synthetic oligonucleotide"
cagauuaugcguaagcugg

SEQ ID NO: 3590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauuaugcguaagcuggtt

SEQ ID NO: 3591 - RNA, 19 nt, Artificial Sequence
  source: /note="Description of Artificial Sequence: Synthetic oligonucleotide"
ccagcuuacgcauaaucug

SEQ ID NO: 3592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcuuacgcauaaucugtt

SEQ ID NO: 3593 - RNA, 19 nt, Artificial Sequence
  source: /note="Description of Artificial Sequence: Synthetic oligonucleotide"
uacaccucguccaucgaug

SEQ ID NO: 3594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaccucguccaucgaugtt

SEQ ID NO: 3595 - RNA, 19 nt, Artificial Sequence
  source: /note="Description of Artificial Sequence: Synthetic oligonucleotide"
caucgauggacgaggugua

SEQ ID NO: 3596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucgauggacgagguguatt

SEQ ID NO: 3597 - RNA, 19 nt, Artificial Sequence
  source: /note="Description of Artificial Sequence: Synthetic oligonucleotide"
ggcgggaaagcgucagucg

SEQ ID NO: 3598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggaaagcgucagucgtt

SEQ ID NO: 3599 - RNA, 19 nt, Artificial Sequence
  source: /note="Description of Artificial Sequence: Synthetic oligonucleotide"
cgacugacgcuuucccgcc

SEQ ID NO: 3600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacugacgcuuucccgcctt

SEQ ID NO: 3601 - RNA, 19 nt, Artificial Sequence
  source: /note="Description of Artificial Sequence: Synthetic oligonucleotide"
gugacagcgggaaggugac

SEQ ID NO: 3602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugacagcgggaaggugactt

SEQ ID NO: 3603 - RNA, 19 nt, Artificial Sequence
  source: /note="Description of Artificial Sequence: Synthetic oligonucleotide"
gucaccuucccgcugucac

SEQ ID NO: 3604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaccuucccgcugucactt

SEQ ID NO: 3605 - RNA, 19 nt, Artificial Sequence
  source: /note="Description of Artificial Sequence: Synthetic oligonucleotide"
ccaagaaguggcuuacacu

SEQ ID NO: 3606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagaaguggcuuacacutt

SEQ ID NO: 3607 - RNA, 19 nt, Artificial Sequence
  source: /note="Description of Artificial Sequence: Synthetic oligonucleotide"
aguguaagccacuucuugg

SEQ ID NO: 3608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguguaagccacuucuuggtt

SEQ ID NO: 3609 - RNA, 19 nt, Artificial Sequence
  source: /note="Description of Artificial Sequence: Synthetic oligonucleotide"
gaaggacgagcuguauuug

SEQ ID NO: 3610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggacgagcuguauuugtt

SEQ ID NO: 3611 - RNA, 19 nt, Artificial Sequence
  source: /note="Description of Artificial Sequence: Synthetic oligonucleotide"
caaauacagcucguccuuc

SEQ ID NO: 3612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauacagcucguccuuctt

SEQ ID NO: 3613 - RNA, 19 nt, Artificial Sequence
  source: /note="Description of Artificial Sequence: Synthetic oligonucleotide"
aaggacgagcuguauuuga

SEQ ID NO: 3614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggacgagcuguauuugatt

SEQ ID NO: 3615 - RNA, 19 nt, Artificial Sequence
  source: /note="Description of Artificial Sequence: Synthetic oligonucleotide"
ucaaauacagcucguccuu

SEQ ID NO: 3616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaauacagcucguccuutt

SEQ ID NO: 3617 - RNA, 19 nt, Artificial Sequence
  source: /note="Description of Artificial Sequence: Synthetic oligonucleotide"
gcugaucaccccuaucauc

SEQ ID NO: 3618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugaucaccccuaucauctt

SEQ ID NO: 3619 - RNA, 19 nt, Artificial Sequence
  source: /note="Description of Artificial Sequence: Synthetic oligonucleotide"
gaugauaggggugaucagc

SEQ ID NO: 3620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugauaggggugaucagctt

SEQ ID NO: 3621 - RNA, 19 nt, Artificial Sequence
  source: /note="Description of Artificial Sequence: Synthetic oligonucleotide"
cucuagccuacuggaguac

SEQ ID NO: 3622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuagccuacuggaguactt

SEQ ID NO: 3623 - RNA, 19 nt, Artificial Sequence
  source: /note="Description of Artificial Sequence: Synthetic oligonucleotide"
guacuccaguaggcuagag

SEQ ID NO: 3624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuccaguaggcuagagtt

SEQ ID NO: 3625 - RNA, 19 nt, Artificial Sequence
  source: /note="Description of Artificial Sequence: Synthetic oligonucleotide"
agugguagccacuguaggc

SEQ ID NO: 3626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugguagccacuguaggctt

SEQ ID NO: 3627 - RNA, 19 nt, Artificial Sequence
  source: /note="Description of Artificial Sequence: Synthetic oligonucleotide"
gccuacaguggcuaccacu

SEQ ID NO: 3628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuacaguggcuaccacutt

SEQ ID NO: 3629 - RNA, 19 nt, Artificial Sequence
  source: /note="Description of Artificial Sequence: Synthetic oligonucleotide"
gcuacccucgcuagcucuu

SEQ ID NO: 3630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuacccucgcuagcucuutt

SEQ ID NO: 3631 - RNA, 19 nt, Artificial Sequence
  source: /note="Description of Artificial Sequence: Synthetic oligonucleotide"
aagagcuagcgaggguagc

SEQ ID NO: 3632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagagcuagcgaggguagctt

SEQ ID NO: 3633 - RNA, 19 nt, Artificial Sequence
  source: /note="Description of Artificial Sequence: Synthetic oligonucleotide"
cuacccucgcuagcucuuc

SEQ ID NO: 3634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacccucgcuagcucuuctt

SEQ ID NO: 3635 - RNA, 19 nt, Artificial Sequence
  source: /note="Description of Artificial Sequence: Synthetic oligonucleotide"
gaagagcuagcgaggguag

SEQ ID NO: 3636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagagcuagcgaggguagtt

SEQ ID NO: 3637 - RNA, 19 nt, Artificial Sequence
  source: /note="Description of Artificial Sequence: Synthetic oligonucleotide"
agauuaugcguaagcugga

SEQ ID NO: 3638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuaugcguaagcuggatt

SEQ ID NO: 3639 - RNA, 19 nt, Artificial Sequence
  source: /note="Description of Artificial Sequence: Synthetic oligonucleotide"
uccagcuuacgcauaaucu

SEQ ID NO: 3640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagcuuacgcauaaucutt

SEQ ID NO: 3641 - RNA, 19 nt, Artificial Sequence
  source: /note="Description of Artificial Sequence: Synthetic oligonucleotide"
cuacuucucggccagccca

SEQ ID NO: 3642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacuucucggccagcccatt

SEQ ID NO: 3643 - RNA, 19 nt, Artificial Sequence
  source: /note="Description of Artificial Sequence: Synthetic oligonucleotide"
ugggcuggccgagaaguag

SEQ ID NO: 3644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuggccgagaaguagtt

SEQ ID NO: 3645 - RNA, 19 nt, Artificial Sequence
  source: /note="Description of Artificial Sequence: Synthetic oligonucleotide"
ccggcgugccccgcggcgg

SEQ ID NO: 3646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcgugccccgcggcggtt

SEQ ID NO: 3647 - RNA, 19 nt, Artificial Sequence
  source: /note="Description of Artificial Sequence: Synthetic oligonucleotide"
ccgccgcggggcacgccgg

SEQ ID NO: 3648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgcggggcacgccggtt

SEQ ID NO: 3649 - RNA, 19 nt, Artificial Sequence
  source: /note="Description of Artificial Sequence: Synthetic oligonucleotide"
gcggcgggccuucgggagg

SEQ ID NO: 3650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcgggccuucgggaggtt

SEQ ID NO: 3651 - RNA, 19 nt, Artificial Sequence
  source: /note="Description of Artificial Sequence: Synthetic oligonucleotide"
ccucccgaaggcccgccgc

SEQ ID NO: 3652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucccgaaggcccgccgctt

SEQ ID NO: 3653 - RNA, 19 nt, Artificial Sequence
  source: /note="Description of Artificial Sequence: Synthetic oligonucleotide"
ccugggggcucgggccggg

SEQ ID NO: 3654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggggcucgggccgggtt

SEQ ID NO: 3655 - RNA, 19 nt, Artificial Sequence
  source: /note="Description of Artificial Sequence: Synthetic oligonucleotide"
cccggcccgagcccccagg

SEQ ID NO: 3656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggcccgagcccccaggtt

SEQ ID NO: 3657 - RNA, 19 nt, Artificial Sequence
  source: /note="Description of Artificial Sequence: Synthetic oligonucleotide"
cgucagucggggcuauggg

SEQ ID NO: 3658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucagucggggcuaugggtt

SEQ ID NO: 3659 - RNA, 19 nt, Artificial Sequence
  source: /note="Description of Artificial Sequence: Synthetic oligonucleotide"
cccauagccccgacugacg

SEQ ID NO: 3660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccauagccccgacugacgtt

SEQ ID NO: 3661 - RNA, 19 nt, Artificial Sequence
  source: /note="Description of Artificial Sequence: Synthetic oligonucleotide"
gggcacuagcuucccgccg

SEQ ID NO: 3662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcacuagcuucccgccgtt

SEQ ID NO: 3663 - RNA, 19 nt, Artificial Sequence
  source: /note="Description of Artificial Sequence: Synthetic oligonucleotide"
cggcgggaagcuagugccc

SEQ ID NO: 3664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgggaagcuagugccctt

SEQ ID NO: 3665 - RNA, 19 nt, Artificial Sequence
  source: /note="Description of Artificial Sequence: Synthetic oligonucleotide"
aaguggcuuacacugacau

SEQ ID NO: 3666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguggcuuacacugacautt

SEQ ID NO: 3667 - RNA, 19 nt, Artificial Sequence
  source: /note="Description of Artificial Sequence: Synthetic oligonucleotide"
augucaguguaagccacuu

SEQ ID NO: 3668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augucaguguaagccacuutt

SEQ ID NO: 3669 - RNA, 19 nt, Artificial Sequence
  source: /note="Description of Artificial Sequence: Synthetic oligonucleotide"
aaccgagaacugcagauua

SEQ ID NO: 3670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccgagaacugcagauuatt

SEQ ID NO: 3671 - RNA, 19 nt, Artificial Sequence
  source: /note="Description of Artificial Sequence: Synthetic oligonucleotide"
uaaucugcaguucucgguu

SEQ ID NO: 3672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaucugcaguucucgguutt

SEQ ID NO: 3673 - RNA, 19 nt, Artificial Sequence
  source: /note="Description of Artificial Sequence: Synthetic oligonucleotide"
ggccuacauccacucccaa

SEQ ID NO: 3674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuacauccacucccaatt

SEQ ID NO: 3675 - RNA, 19 nt, Artificial Sequence
  source: /note="Description of Artificial Sequence: Synthetic oligonucleotide"
uugggaguggauguaggcc

SEQ ID NO: 3676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggaguggauguaggcctt

SEQ ID NO: 3677 - RNA, 19 nt, Artificial Sequence
  source: /note="Description of Artificial Sequence: Synthetic oligonucleotide"
agcugguucggggggagcc

SEQ ID NO: 3678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugguucggggggagcctt

SEQ ID NO: 3679 - RNA, 19 nt, Artificial Sequence
  source: /note="Description of Artificial Sequence: Synthetic oligonucleotide"
ggcuccccccgaaccagcu

SEQ ID NO: 3680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccccccgaaccagcutt

SEQ ID NO: 3681 - RNA, 19 nt, Artificial Sequence
  source: /note="Description of Artificial Sequence: Synthetic oligonucleotide"
uuacaccucguccaucgau

SEQ ID NO: 3682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacaccucguccaucgautt

SEQ ID NO: 3683 - RNA, 19 nt, Artificial Sequence
  source: /note="Description of Artificial Sequence: Synthetic oligonucleotide"
aucgauggacgagguguaa

SEQ ID NO: 3684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgauggacgagguguaatt

SEQ ID NO: 3685 - RNA, 19 nt, Artificial Sequence
  source: /note="Description of Artificial Sequence: Synthetic oligonucleotide"
auugcacucugcucuagcc

SEQ ID NO: 3686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugcacucugcucuagcctt

SEQ ID NO: 3687 - RNA, 19 nt, Artificial Sequence
  source: /note="Description of Artificial Sequence: Synthetic oligonucleotide"
ggcuagagcagagugcaau

SEQ ID NO: 3688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuagagcagagugcaautt

SEQ ID NO: 3689 - RNA, 19 nt, Artificial Sequence
  source: /note="Description of Artificial Sequence: Synthetic oligonucleotide"
cuccccacucgaggcuugu

SEQ ID NO: 3690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccacucgaggcuugutt

SEQ ID NO: 3691 - RNA, 19 nt, Artificial Sequence
  source: /note="Description of Artificial Sequence: Synthetic oligonucleotide"
acaagccucgaguggggag

SEQ ID NO: 3692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagccucgaguggggagtt

SEQ ID NO: 3693 - RNA, 19 nt, Artificial Sequence
  source: /note="Description of Artificial Sequence: Synthetic oligonucleotide"
ccaucucucaaugccauuc

SEQ ID NO: 3694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucucucaaugccauuctt

SEQ ID NO: 3695 - RNA, 19 nt, Artificial Sequence
  source: /note="Description of Artificial Sequence: Synthetic oligonucleotide"
gaauggcauugagagaugg

SEQ ID NO: 3696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauggcauugagagauggtt

SEQ ID NO: 3697 - RNA, 19 nt, Artificial Sequence
  source: /note="Description of Artificial Sequence: Synthetic oligonucleotide"
gggcgcugggccggagccg

SEQ ID NO: 3698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcgcugggccggagccgtt

SEQ ID NO: 3699 - RNA, 19 nt, Artificial Sequence
  source: /note="Description of Artificial Sequence: Synthetic oligonucleotide"
cggcuccggcccagcgccc

SEQ ID NO: 3700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcuccggcccagcgccctt

SEQ ID NO: 3701 - RNA, 19 nt, Artificial Sequence
  source: /note="Description of Artificial Sequence: Synthetic oligonucleotide"
ggcgggggcagcccaggca

SEQ ID NO: 3702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggggcagcccaggcatt

SEQ ID NO: 3703 - RNA, 19 nt, Artificial Sequence
  source: /note="Description of Artificial Sequence: Synthetic oligonucleotide"
ugccugggcugcccccgcc

SEQ ID NO: 3704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccugggcugcccccgcctt

SEQ ID NO: 3705 - RNA, 19 nt, Artificial Sequence
  source: /note="Description of Artificial Sequence: Synthetic oligonucleotide"
ggggcagcccaggcagccc

SEQ ID NO: 3706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcagcccaggcagccctt

SEQ ID NO: 3707 - RNA, 19 nt, Artificial Sequence
  source: /note="Description of Artificial Sequence: Synthetic oligonucleotide"
gggcugccugggcugcccc

SEQ ID NO: 3708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcugccugggcugcccctt

SEQ ID NO: 3709 - RNA, 19 nt, Artificial Sequence
  source: /note="Description of Artificial Sequence: Synthetic oligonucleotide"
ggcggcgggccuucgggag

SEQ ID NO: 3710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcgggccuucgggagtt

SEQ ID NO: 3711 - RNA, 19 nt, Artificial Sequence
  source: /note="Description of Artificial Sequence: Synthetic oligonucleotide"
cucccgaaggcccgccgcc

SEQ ID NO: 3712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccgaaggcccgccgcctt

SEQ ID NO: 3713 - RNA, 19 nt, Artificial Sequence
  source: /note="Description of Artificial Sequence: Synthetic oligonucleotide"
caggaggcacuggcggcgg

SEQ ID NO: 3714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaggcacuggcggcggtt

SEQ ID NO: 3715 - RNA, 19 nt, Artificial Sequence
  source: /note="Description of Artificial Sequence: Synthetic oligonucleotide"
ccgccgccagugccuccug

SEQ ID NO: 3716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgccagugccuccugtt

SEQ ID NO: 3717 - RNA, 19 nt, Artificial Sequence
  source: /note="Description of Artificial Sequence: Synthetic oligonucleotide"
ggcagcgguggccccggcg

SEQ ID NO: 3718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcgguggccccggcgtt

SEQ ID NO: 3719 - RNA, 19 nt, Artificial Sequence
  source: /note="Description of Artificial Sequence: Synthetic oligonucleotide"
cgccggggccaccgcugcc

SEQ ID NO: 3720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccggggccaccgcugcctt

SEQ ID NO: 3721 - RNA, 19 nt, Artificial Sequence
  source: /note="Description of Artificial Sequence: Synthetic oligonucleotide"
ugaccacagugguagccac

SEQ ID NO: 3722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaccacagugguagccactt

SEQ ID NO: 3723 - RNA, 19 nt, Artificial Sequence
  source: /note="Description of Artificial Sequence: Synthetic oligonucleotide"
guggcuaccacugugguca

SEQ ID NO: 3724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcuaccacuguggucatt

SEQ ID NO: 3725 - RNA, 19 nt, Artificial Sequence
  source: /note="Description of Artificial Sequence: Synthetic oligonucleotide"
agccacuguaggccaaggc

SEQ ID NO: 3726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccacuguaggccaaggctt

SEQ ID NO: 3727 - RNA, 19 nt, Artificial Sequence
  source: /note="Description of Artificial Sequence: Synthetic oligonucleotide"
gccuuggccuacaguggcu

SEQ ID NO: 3728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuuggccuacaguggcutt

SEQ ID NO: 3729 - RNA, 19 nt, Artificial Sequence
  source: /note="Description of Artificial Sequence: Synthetic oligonucleotide"
aguggcuuacacugacauc

SEQ ID NO: 3730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcuuacacugacauctt

SEQ ID NO: 3731 - RNA, 19 nt, Artificial Sequence
  source: /note="Description of Artificial Sequence: Synthetic oligonucleotide"
gaugucaguguaagccacu

SEQ ID NO: 3732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugucaguguaagccacutt

SEQ ID NO: 3733 - RNA, 19 nt, Artificial Sequence
  source: /note="Description of Artificial Sequence: Synthetic oligonucleotide"
gcuggcagagacgagggaa

SEQ ID NO: 3734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggcagagacgagggaatt

SEQ ID NO: 3735 - RNA, 19 nt, Artificial Sequence
  source: /note="Description of Artificial Sequence: Synthetic oligonucleotide"
uucccucgucucugccagc

SEQ ID NO: 3736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccucgucucugccagctt

SEQ ID NO: 3737 - RNA, 19 nt, Artificial Sequence
  source: /note="Description of Artificial Sequence: Synthetic oligonucleotide"
cgguguaccgaguggcccg

SEQ ID NO: 3738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguguaccgaguggcccgtt

SEQ ID NO: 3739 - RNA, 19 nt, Artificial Sequence
  source: /note="Description of Artificial Sequence: Synthetic oligonucleotide"
cgggccacucgguacaccg

SEQ ID NO: 3740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggccacucgguacaccgtt

SEQ ID NO: 3741 - RNA, 19 nt, Artificial Sequence
  source: /note="Description of Artificial Sequence: Synthetic oligonucleotide"
gccaagcugaucaccccua

SEQ ID NO: 3742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaagcugaucaccccuatt

SEQ ID NO: 3743 - RNA, 19 nt, Artificial Sequence
  source: /note="Description of Artificial Sequence: Synthetic oligonucleotide"
uaggggugaucagcuuggc

SEQ ID NO: 3744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggggugaucagcuuggctt

SEQ ID NO: 3745 - RNA, 19 nt, Artificial Sequence
  source: /note="Description of Artificial Sequence: Synthetic oligonucleotide"
agcugaucaccccuaucau

SEQ ID NO: 3746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugaucaccccuaucautt

SEQ ID NO: 3747 - RNA, 19 nt, Artificial Sequence
  source: /note="Description of Artificial Sequence: Synthetic oligonucleotide"
augauaggggugaucagcu

SEQ ID NO: 3748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augauaggggugaucagcutt

SEQ ID NO: 3749 - RNA, 19 nt, Artificial Sequence
  source: /note="Description of Artificial Sequence: Synthetic oligonucleotide"
aucaucuacaucaaggugu

SEQ ID NO: 3750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaucuacaucaaggugutt

SEQ ID NO: 3751 - RNA, 19 nt, Artificial Sequence
  source: /note="Description of Artificial Sequence: Synthetic oligonucleotide"
acaccuugauguagaugau

SEQ ID NO: 3752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccuugauguagaugautt

SEQ ID NO: 3753 - RNA, 19 nt, Artificial Sequence
  source: /note="Description of Artificial Sequence: Synthetic oligonucleotide"
ucaucuacaucaaggugua

SEQ ID NO: 3754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucuacaucaagguguatt

SEQ ID NO: 3755 - RNA, 19 nt, Artificial Sequence
  source: /note="Description of Artificial Sequence: Synthetic oligonucleotide"
uacaccuugauguagauga

SEQ ID NO: 3756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaccuugauguagaugatt

SEQ ID NO: 3757 - RNA, 19 nt, Artificial Sequence
  source: /note="Description of Artificial Sequence: Synthetic oligonucleotide"
gccuacauccacucccaag

SEQ ID NO: 3758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuacauccacucccaagtt

SEQ ID NO: 3759 - RNA, 19 nt, Artificial Sequence
  source: /note="Description of Artificial Sequence: Synthetic oligonucleotide"
cuugggaguggauguaggc

SEQ ID NO: 3760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugggaguggauguaggctt

SEQ ID NO: 3761 - RNA, 19 nt, Artificial Sequence
  source: /note="Description of Artificial Sequence: Synthetic oligonucleotide"
ccaaggugugugucaccgu

SEQ ID NO: 3762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggugugugucaccgutt

SEQ ID NO: 3763 - RNA, 19 nt, Artificial Sequence
  source: /note="Description of Artificial Sequence: Synthetic oligonucleotide"
acggugacacacaccuugg

SEQ ID NO: 3764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggugacacacaccuuggtt

SEQ ID NO: 3765 - RNA, 19 nt, Artificial Sequence
  source: /note="Description of Artificial Sequence: Synthetic oligonucleotide"
uggagccacagauuacacc

SEQ ID NO: 3766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagccacagauuacacctt

SEQ ID NO: 3767 - RNA, 19 nt, Artificial Sequence
  source: /note="Description of Artificial Sequence: Synthetic oligonucleotide"
gguguaaucuguggcucca

SEQ ID NO: 3768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguaaucuguggcuccatt

SEQ ID NO: 3769 - RNA, 19 nt, Artificial Sequence
  source: /note="Description of Artificial Sequence: Synthetic oligonucleotide"
gauguguggucggcuggcu

SEQ ID NO: 3770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauguguggucggcuggcutt

SEQ ID NO: 3771 - RNA, 19 nt, Artificial Sequence
  source: /note="Description of Artificial Sequence: Synthetic oligonucleotide"
agccagccgaccacacauc

SEQ ID NO: 3772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccagccgaccacacauctt

SEQ ID NO: 3773 - RNA, 19 nt, Artificial Sequence
  source: /note="Description of Artificial Sequence: Synthetic oligonucleotide"
uggggacagugggguggac

SEQ ID NO: 3774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggacagugggguggactt

SEQ ID NO: 3775 - RNA, 19 nt, Artificial Sequence
  source: /note="Description of Artificial Sequence: Synthetic oligonucleotide"
guccaccccacugucccca

SEQ ID NO: 3776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaccccacuguccccatt

SEQ ID NO: 3777 - RNA, 19 nt, Artificial Sequence
  source: /note="Description of Artificial Sequence: Synthetic oligonucleotide"
agcucacccuuggacaaag

SEQ ID NO: 3778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucacccuuggacaaagtt

SEQ ID NO: 3779 - RNA, 19 nt, Artificial Sequence
  source: /note="Description of Artificial Sequence: Synthetic oligonucleotide"
cuuuguccaagggugagcu

SEQ ID NO: 3780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuguccaagggugagcutt

SEQ ID NO: 3781 - RNA, 19 nt, Artificial Sequence
  source: /note="Description of Artificial Sequence: Synthetic oligonucleotide"
gcucacccuuggacaaagg

SEQ ID NO: 3782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucacccuuggacaaaggtt

SEQ ID NO: 3783 - RNA, 19 nt, Artificial Sequence
  source: /note="Description of Artificial Sequence: Synthetic oligonucleotide"
ccuuuguccaagggugagc

SEQ ID NO: 3784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuguccaagggugagctt

SEQ ID NO: 3785 - RNA, 19 nt, Artificial Sequence
  source: /note="Description of Artificial Sequence: Synthetic oligonucleotide"
gguguucaaaucuucaaag

SEQ ID NO: 3786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguucaaaucuucaaagtt

SEQ ID NO: 3787 - RNA, 19 nt, Artificial Sequence
  source: /note="Description of Artificial Sequence: Synthetic oligonucleotide"
cuuugaagauuugaacacc

SEQ ID NO: 3788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugaagauuugaacacctt

SEQ ID NO: 3789 - RNA, 19 nt, Artificial Sequence
  source: /note="Description of Artificial Sequence: Synthetic oligonucleotide"
uugcacucugcucuagccu

SEQ ID NO: 3790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcacucugcucuagccutt

SEQ ID NO: 3791 - RNA, 19 nt, Artificial Sequence
  source: /note="Description of Artificial Sequence: Synthetic oligonucleotide"
aggcuagagcagagugcaa

SEQ ID NO: 3792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuagagcagagugcaatt

SEQ ID NO: 3793 - RNA, 19 nt, Artificial Sequence
  source: /note="Description of Artificial Sequence: Synthetic oligonucleotide"
acacgccauccucaaggcu

SEQ ID NO: 3794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacgccauccucaaggcutt

SEQ ID NO: 3795 - RNA, 19 nt, Artificial Sequence
  source: /note="Description of Artificial Sequence: Synthetic oligonucleotide"
agccuugaggauggcgugu

SEQ ID NO: 3796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuugaggauggcgugutt

SEQ ID NO: 3797 - RNA, 19 nt, Artificial Sequence
  source: /note="Description of Artificial Sequence: Synthetic oligonucleotide"
uccccacucgaggcuugug

SEQ ID NO: 3798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccacucgaggcuugugtt

SEQ ID NO: 3799 - RNA, 19 nt, Artificial Sequence
  source: /note="Description of Artificial Sequence: Synthetic oligonucleotide"
cacaagccucgagugggga

SEQ ID NO: 3800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaagccucgaguggggatt

SEQ ID NO: 3801 - RNA, 19 nt, Artificial Sequence
  source: /note="Description of Artificial Sequence: Synthetic oligonucleotide"
cacagcuucuucgaugaac

SEQ ID NO: 3802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagcuucuucgaugaactt

SEQ ID NO: 3803 - RNA, 19 nt, Artificial Sequence
  source: /note="Description of Artificial Sequence: Synthetic oligonucleotide"
guucaucgaagaagcugug

SEQ ID NO: 3804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaucgaagaagcugugtt

SEQ ID NO: 3805 - RNA, 19 nt, Artificial Sequence
  source: /note="Description of Artificial Sequence: Synthetic oligonucleotide"
agcuucuucgaugaacugc

SEQ ID NO: 3806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuucuucgaugaacugctt

SEQ ID NO: 3807 - RNA, 19 nt, Artificial Sequence
  source: /note="Description of Artificial Sequence: Synthetic oligonucleotide"
gcaguucaucgaagaagcu

SEQ ID NO: 3808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaguucaucgaagaagcutt

SEQ ID NO: 3809 - RNA, 19 nt, Artificial Sequence
  source: /note="Description of Artificial Sequence: Synthetic oligonucleotide"
cgaccgcccgcuucccccc

SEQ ID NO: 3810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaccgcccgcuucccccctt

SEQ ID NO: 3811 - RNA, 19 nt, Artificial Sequence
  source: /note="Description of Artificial Sequence: Synthetic oligonucleotide"
ggggggaagcgggcggucg

SEQ ID NO: 3812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggggaagcgggcggucgtt

SEQ ID NO: 3813 - RNA, 19 nt, Artificial Sequence
  source: /note="Description of Artificial Sequence: Synthetic oligonucleotide"
ccgcccgcuucccccccug

SEQ ID NO: 3814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcccgcuucccccccugtt

SEQ ID NO: 3815 - RNA, 19 nt, Artificial Sequence
  source: /note="Description of Artificial Sequence: Synthetic oligonucleotide"
cagggggggaagcgggcgg

SEQ ID NO: 3816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggggggaagcgggcggtt

SEQ ID NO: 3817 - RNA, 19 nt, Artificial Sequence
  source: /note="Description of Artificial Sequence: Synthetic oligonucleotide"
uucaguccuggugaacugu

SEQ ID NO: 3818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaguccuggugaacugutt

SEQ ID NO: 3819 - RNA, 19 nt, Artificial Sequence
  source: /note="Description of Artificial Sequence: Synthetic oligonucleotide"
acaguucaccaggacugaa

SEQ ID NO: 3820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguucaccaggacugaatt

SEQ ID NO: 3821 - RNA, 19 nt, Artificial Sequence
  source: /note="Description of Artificial Sequence: Synthetic oligonucleotide"
ucaguccuggugaacuguc

SEQ ID NO: 3822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguccuggugaacuguctt

SEQ ID NO: 3823 - RNA, 19 nt, Artificial Sequence
  source: /note="Description of Artificial Sequence: Synthetic oligonucleotide"
gacaguucaccaggacuga

SEQ ID NO: 3824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaguucaccaggacugatt

SEQ ID NO: 3825 - RNA, 19 nt, Artificial Sequence
  source: /note="Description of Artificial Sequence: Synthetic oligonucleotide"
cuguccauccaaccaucuc

SEQ ID NO: 3826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguccauccaaccaucuctt

SEQ ID NO: 3827 - RNA, 19 nt, Artificial Sequence
  source: /note="Description of Artificial Sequence: Synthetic oligonucleotide"
gagaugguuggauggacag

SEQ ID NO: 3828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaugguuggauggacagtt

SEQ ID NO: 3829 - RNA, 19 nt, Artificial Sequence
  source: /note="Description of Artificial Sequence: Synthetic oligonucleotide"
uguccauccaaccaucucu

SEQ ID NO: 3830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccauccaaccaucucutt

SEQ ID NO: 3831 - RNA, 19 nt, Artificial Sequence
  source: /note="Description of Artificial Sequence: Synthetic oligonucleotide"
agagaugguuggauggaca

SEQ ID NO: 3832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagaugguuggauggacatt

SEQ ID NO: 3833 - RNA, 19 nt, Artificial Sequence
  source: /note="Description of Artificial Sequence: Synthetic oligonucleotide"
caucucucaaugccauucu

SEQ ID NO: 3834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucucucaaugccauucutt

SEQ ID NO: 3835 - RNA, 19 nt, Artificial Sequence
  source: /note="Description of Artificial Sequence: Synthetic oligonucleotide"
agaauggcauugagagaug

SEQ ID NO: 3836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaauggcauugagagaugtt

SEQ ID NO: 3837 - RNA, 19 nt, Artificial Sequence
  source: /note="Description of Artificial Sequence: Synthetic oligonucleotide"
ccccucaccacuuccuaca

SEQ ID NO: 3838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccucaccacuuccuacatt

SEQ ID NO: 3839 - RNA, 19 nt, Artificial Sequence
  source: /note="Description of Artificial Sequence: Synthetic oligonucleotide"
uguaggaaguggugagggg

SEQ ID NO: 3840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaggaaguggugaggggtt

SEQ ID NO: 3841 - RNA, 19 nt, Artificial Sequence
  source: /note="Description of Artificial Sequence: Synthetic oligonucleotide"
aagcucagacuggccaaga

SEQ ID NO: 3842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcucagacuggccaagatt

SEQ ID NO: 3843 - RNA, 19 nt, Artificial Sequence
  source: /note="Description of Artificial Sequence: Synthetic oligonucleotide"
ucuuggccagucugagcuu

SEQ ID NO: 3844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuggccagucugagcuutt

SEQ ID NO: 3845 - RNA, 19 nt, Artificial Sequence
  source: /note="Description of Artificial Sequence: Synthetic oligonucleotide"
uccugagggccccaccgac

SEQ ID NO: 3846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugagggccccaccgactt

SEQ ID NO: 3847 - RNA, 19 nt, Artificial Sequence
  source: /note="Description of Artificial Sequence: Synthetic oligonucleotide"
gucgguggggcccucagga

SEQ ID NO: 3848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucgguggggcccucaggatt

SEQ ID NO: 3849 - RNA, 19 nt, Artificial Sequence
  source: /note="Description of Artificial Sequence: Synthetic oligonucleotide"
cagcagccuaaccucugug

SEQ ID NO: 3850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcagccuaaccucugugtt

SEQ ID NO: 3851 - RNA, 19 nt, Artificial Sequence
  source: /note="Description of Artificial Sequence: Synthetic oligonucleotide"
cacagagguuaggcugcug

SEQ ID NO: 3852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagagguuaggcugcugtt

SEQ ID NO: 3853 - RNA, 19 nt, Artificial Sequence
  source: /note="Description of Artificial Sequence: Synthetic oligonucleotide"
agcagccuaaccucugugg

SEQ ID NO: 3854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagccuaaccucuguggtt

SEQ ID NO: 3855 - RNA, 19 nt, Artificial Sequence
  source: /note="Description of Artificial Sequence: Synthetic oligonucleotide"
ccacagagguuaggcugcu

SEQ ID NO: 3856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagagguuaggcugcutt

SEQ ID NO: 3857 - RNA, 19 nt, Artificial Sequence
  source: /note="Description of Artificial Sequence: Synthetic oligonucleotide"
ugaggaccuucuacccccu

SEQ ID NO: 3858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggaccuucuacccccutt

SEQ ID NO: 3859 - RNA, 19 nt, Artificial Sequence
  source: /note="Description of Artificial Sequence: Synthetic oligonucleotide"
aggggguagaagguccuca

SEQ ID NO: 3860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggguagaagguccucatt

SEQ ID NO: 3861 - RNA, 19 nt, Artificial Sequence
  source: /note="Description of Artificial Sequence: Synthetic oligonucleotide"
gaggaccuucuacccccuu

SEQ ID NO: 3862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggaccuucuacccccuutt

SEQ ID NO: 3863 - RNA, 19 nt, Artificial Sequence
  source: /note="Description of Artificial Sequence: Synthetic oligonucleotide"
aaggggguagaagguccuc

SEQ ID NO: 3864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggggguagaagguccuctt

SEQ ID NO: 3865 - RNA, 19 nt, Artificial Sequence
  source: /note="Description of Artificial Sequence: Synthetic oligonucleotide"
gucuucccuucccuggccc

SEQ ID NO: 3866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuucccuucccuggccctt

SEQ ID NO: 3867 - RNA, 19 nt, Artificial Sequence
  source: /note="Description of Artificial Sequence: Synthetic oligonucleotide"
gggccagggaagggaagac

SEQ ID NO: 3868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccagggaagggaagactt

SEQ ID NO: 3869 - RNA, 19 nt, Artificial Sequence
  source: /note="Description of Artificial Sequence: Synthetic oligonucleotide"
ugccccccccagcuguacc

SEQ ID NO: 3870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccccccccagcuguacctt

SEQ ID NO: 3871 - RNA, 19 nt, Artificial Sequence
  source: /note="Description of Artificial Sequence: Synthetic oligonucleotide"
gguacagcuggggggggca

SEQ ID NO: 3872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacagcuggggggggcatt

SEQ ID NO: 3873 - RNA, 19 nt, Artificial Sequence
  source: /note="Description of Artificial Sequence: Synthetic oligonucleotide"
cccagcuguaccccuucuu

SEQ ID NO: 3874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcuguaccccuucuutt

SEQ ID NO: 3875 - RNA, 19 nt, Artificial Sequence
  source: /note="Description of Artificial Sequence: Synthetic oligonucleotide"
aagaagggguacagcuggg

SEQ ID NO: 3876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaagggguacagcugggtt

SEQ ID NO: 3877 - RNA, 19 nt, Artificial Sequence
  source: /note="Description of Artificial Sequence: Synthetic oligonucleotide"
cuggugucuuaguuuccac

SEQ ID NO: 3878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggugucuuaguuuccactt

SEQ ID NO: 3879 - RNA, 19 nt, Artificial Sequence
  source: /note="Description of Artificial Sequence: Synthetic oligonucleotide"
guggaaacuaagacaccag

SEQ ID NO: 3880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggaaacuaagacaccagtt

SEQ ID NO: 3881 - RNA, 19 nt, Artificial Sequence
  source: /note="Description of Artificial Sequence: Synthetic oligonucleotide"
uuaguuuccacaguaaggu

SEQ ID NO: 3882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaguuuccacaguaaggutt

SEQ ID NO: 3883 - RNA, 19 nt, Artificial Sequence
  source: /note="Description of Artificial Sequence: Synthetic oligonucleotide"
accuuacuguggaaacuaa

SEQ ID NO: 3884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuacuguggaaacuaatt

SEQ ID NO: 3885 - RNA, 19 nt, Artificial Sequence
  source: /note="Description of Artificial Sequence: Synthetic oligonucleotide"
cucuguucaauaaauuauu

SEQ ID NO: 3886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuguucaauaaauuauutt

SEQ ID NO: 3887 - RNA, 19 nt, Artificial Sequence
  source: /note="Description of Artificial Sequence: Synthetic oligonucleotide"
aauaauuuauugaacagag

SEQ ID NO: 3888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauaauuuauugaacagagtt

SEQ ID NO: 3889 - RNA, 19 nt, Artificial Sequence
  source: /note="Description of Artificial Sequence: Synthetic oligonucleotide"
aggcagcccgagccccgcg

SEQ ID NO: 3890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcagcccgagccccgcgtt

SEQ ID NO: 3891 - RNA, 19 nt, Artificial Sequence
  source: /note="Description of Artificial Sequence: Synthetic oligonucleotide"
cgcggggcucgggcugccu

SEQ ID NO: 3892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggggcucgggcugccutt

SEQ ID NO: 3893 - RNA, 19 nt, Artificial Sequence
  source: /note="Description of Artificial Sequence: Synthetic oligonucleotide"
cagcggcggaggaggcagc

SEQ ID NO: 3894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcggcggaggaggcagctt

SEQ ID NO: 3895 - RNA, 19 nt, Artificial Sequence
  source: /note="Description of Artificial Sequence: Synthetic oligonucleotide"
gcugccuccuccgccgcug

SEQ ID NO: 3896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccuccuccgccgcugtt

SEQ ID NO: 3897 - RNA, 19 nt, Artificial Sequence
  source: /note="Description of Artificial Sequence: Synthetic oligonucleotide"
uucccaagaaguggcuuac

SEQ ID NO: 3898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccaagaaguggcuuactt

SEQ ID NO: 3899 - RNA, 19 nt, Artificial Sequence
  source: /note="Description of Artificial Sequence: Synthetic oligonucleotide"
guaagccacuucuugggaa

SEQ ID NO: 3900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaagccacuucuugggaatt

SEQ ID NO: 3901 - RNA, 19 nt, Artificial Sequence
  source: /note="Description of Artificial Sequence: Synthetic oligonucleotide"
gacacugcuguccucaagc

SEQ ID NO: 3902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacugcuguccucaagctt

SEQ ID NO: 3903 - RNA, 19 nt, Artificial Sequence
  source: /note="Description of Artificial Sequence: Synthetic oligonucleotide"
gcuugaggacagcaguguc

SEQ ID NO: 3904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugaggacagcaguguctt

SEQ ID NO: 3905 - RNA, 19 nt, Artificial Sequence
  source: /note="Description of Artificial Sequence: Synthetic oligonucleotide"
cagcuucuucgaugaacug

SEQ ID NO: 3906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuucuucgaugaacugtt

SEQ ID NO: 3907 - RNA, 19 nt, Artificial Sequence
  source: /note="Description of Artificial Sequence: Synthetic oligonucleotide"
caguucaucgaagaagcug

SEQ ID NO: 3908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguucaucgaagaagcugtt

SEQ ID NO: 3909 - RNA, 19 nt, Artificial Sequence
  source: /note="Description of Artificial Sequence: Synthetic oligonucleotide"
cccaucucucgucuucccu

SEQ ID NO: 3910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaucucucgucuucccutt

SEQ ID NO: 3911 - RNA, 19 nt, Artificial Sequence
  source: /note="Description of Artificial Sequence: Synthetic oligonucleotide"
agggaagacgagagauggg

SEQ ID NO: 3912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaagacgagagaugggtt

SEQ ID NO: 3913 - RNA, 19 nt, Artificial Sequence
  source: /note="Description of Artificial Sequence: Synthetic oligonucleotide"
ccaucucucgucuucccuu

SEQ ID NO: 3914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucucucgucuucccuutt

SEQ ID NO: 3915 - RNA, 19 nt, Artificial Sequence
  source: /note="Description of Artificial Sequence: Synthetic oligonucleotide"
aagggaagacgagagaugg

SEQ ID NO: 3916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggaagacgagagauggtt

SEQ ID NO: 3917 - RNA, 19 nt, Artificial Sequence
  source: /note="Description of Artificial Sequence: Synthetic oligonucleotide"
guccucugcucccaaggcu

SEQ ID NO: 3918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccucugcucccaaggcutt

SEQ ID NO: 3919 - RNA, 19 nt, Artificial Sequence
  source: /note="Description of Artificial Sequence: Synthetic oligonucleotide"
agccuugggagcagaggac

SEQ ID NO: 3920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuugggagcagaggactt

SEQ ID NO: 3921 - RNA, 19 nt, Artificial Sequence
  source: /note="Description of Artificial Sequence: Synthetic oligonucleotide"
agagggacuucaucucccg

SEQ ID NO: 3922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagggacuucaucucccgtt

SEQ ID NO: 3923 - RNA, 19 nt, Artificial Sequence
  source: /note="Description of Artificial Sequence: Synthetic oligonucleotide"
cgggagaugaagucccucu

SEQ ID NO: 3924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggagaugaagucccucutt

SEQ ID NO: 3925 - RNA, 19 nt, Artificial Sequence
  source: /note="Description of Artificial Sequence: Synthetic oligonucleotide"
cccgcggcgggcgcugggc

SEQ ID NO: 3926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgcggcgggcgcugggctt

SEQ ID NO: 3927 - RNA, 19 nt, Artificial Sequence
  source: /note="Description of Artificial Sequence: Synthetic oligonucleotide"
gcccagcgcccgccgcggg

SEQ ID NO: 3928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagcgcccgccgcgggtt

SEQ ID NO: 3929 - RNA, 19 nt, Artificial Sequence
  source: /note="Description of Artificial Sequence: Synthetic oligonucleotide"
gagcccaggggaggcggcg

SEQ ID NO: 3930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccaggggaggcggcgtt

SEQ ID NO: 3931 - RNA, 19 nt, Artificial Sequence
  source: /note="Description of Artificial Sequence: Synthetic oligonucleotide"
cgccgccuccccugggcuc

SEQ ID NO: 3932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgccuccccugggcuctt

SEQ ID NO: 3933 - RNA, 19 nt, Artificial Sequence
  source: /note="Description of Artificial Sequence: Synthetic oligonucleotide"
gcagaggcagcggcggggg

SEQ ID NO: 3934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagaggcagcggcgggggtt

SEQ ID NO: 3935 - RNA, 19 nt, Artificial Sequence
  source: /note="Description of Artificial Sequence: Synthetic oligonucleotide"
cccccgccgcugccucugc

SEQ ID NO: 3936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccgccgcugccucugctt

SEQ ID NO: 3937 - RNA, 19 nt, Artificial Sequence
  source: /note="Description of Artificial Sequence: Synthetic oligonucleotide"
gcagcccgagccccgcggc

SEQ ID NO: 3938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcccgagccccgcggctt

SEQ ID NO: 3939 - RNA, 19 nt, Artificial Sequence
  source: /note="Description of Artificial Sequence: Synthetic oligonucleotide"
gccgcggggcucgggcugc

SEQ ID NO: 3940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcggggcucgggcugctt

SEQ ID NO: 3941 - RNA, 19 nt, Artificial Sequence
  source: /note="Description of Artificial Sequence: Synthetic oligonucleotide"
cggagccaggaggcggagg

SEQ ID NO: 3942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagccaggaggcggaggtt

SEQ ID NO: 3943 - RNA, 19 nt, Artificial Sequence
  source: /note="Description of Artificial Sequence: Synthetic oligonucleotide"
ccuccgccuccuggcuccg

SEQ ID NO: 3944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccgccuccuggcuccgtt

SEQ ID NO: 3945 - RNA, 19 nt, Artificial Sequence
  source: /note="Description of Artificial Sequence: Synthetic oligonucleotide"
gagccaggaggcggaggcg

SEQ ID NO: 3946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccaggaggcggaggcgtt

SEQ ID NO: 3947 - RNA, 19 nt, Artificial Sequence
  source: /note="Description of Artificial Sequence: Synthetic oligonucleotide"
cgccuccgccuccuggcuc

SEQ ID NO: 3948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccuccgccuccuggcuctt

SEQ ID NO: 3949 - RNA, 19 nt, Artificial Sequence
  source: /note="Description of Artificial Sequence: Synthetic oligonucleotide"
aggccaaggcccagagcgu

SEQ ID NO: 3950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccaaggcccagagcgutt

SEQ ID NO: 3951 - RNA, 19 nt, Artificial Sequence
  source: /note="Description of Artificial Sequence: Synthetic oligonucleotide"
acgcucugggccuuggccu

SEQ ID NO: 3952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgcucugggccuuggccutt

SEQ ID NO: 3953 - RNA, 19 nt, Artificial Sequence
  source: /note="Description of Artificial Sequence: Synthetic oligonucleotide"
aagaaccgagaacugcaga

SEQ ID NO: 3954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaccgagaacugcagatt

SEQ ID NO: 3955 - RNA, 19 nt, Artificial Sequence
  source: /note="Description of Artificial Sequence: Synthetic oligonucleotide"
ucugcaguucucgguucuu

SEQ ID NO: 3956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcaguucucgguucuutt

SEQ ID NO: 3957 - RNA, 19 nt, Artificial Sequence
  source: /note="Description of Artificial Sequence: Synthetic oligonucleotide"
ugaggcugcgguacuuuuu

SEQ ID NO: 3958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggcugcgguacuuuuutt

SEQ ID NO: 3959 - RNA, 19 nt, Artificial Sequence
  source: /note="Description of Artificial Sequence: Synthetic oligonucleotide"
aaaaaguaccgcagccuca

SEQ ID NO: 3960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaaguaccgcagccucatt

SEQ ID NO: 3961 - RNA, 19 nt, Artificial Sequence
  source: /note="Description of Artificial Sequence: Synthetic oligonucleotide"
gaggcugcgguacuuuuuc

SEQ ID NO: 3962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcugcgguacuuuuuctt

SEQ ID NO: 3963 - RNA, 19 nt, Artificial Sequence
  source: /note="Description of Artificial Sequence: Synthetic oligonucleotide"
gaaaaaguaccgcagccuc

SEQ ID NO: 3964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaaaguaccgcagccuctt

SEQ ID NO: 3965 - RNA, 19 nt, Artificial Sequence
  source: /note="Description of Artificial Sequence: Synthetic oligonucleotide"
acgguguaccgaguggccc

SEQ ID NO: 3966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgguguaccgaguggccctt

SEQ ID NO: 3967 - RNA, 19 nt, Artificial Sequence
  source: /note="Description of Artificial Sequence: Synthetic oligonucleotide"
gggccacucgguacaccgu

SEQ ID NO: 3968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccacucgguacaccgutt

SEQ ID NO: 3969 - RNA, 19 nt, Artificial Sequence
  source: /note="Description of Artificial Sequence: Synthetic oligonucleotide"
caaggugugugucaccgug

SEQ ID NO: 3970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggugugugucaccgugtt

SEQ ID NO: 3971 - RNA, 19 nt, Artificial Sequence
  source: /note="Description of Artificial Sequence: Synthetic oligonucleotide"
cacggugacacacaccuug

SEQ ID NO: 3972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacggugacacacaccuugtt

SEQ ID NO: 3973 - RNA, 19 nt, Artificial Sequence
  source: /note="Description of Artificial Sequence: Synthetic oligonucleotide"
ggcuguguacuugcugagc

SEQ ID NO: 3974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuguguacuugcugagctt

SEQ ID NO: 3975 - RNA, 19 nt, Artificial Sequence
  source: /note="Description of Artificial Sequence: Synthetic oligonucleotide"
gcucagcaaguacacagcc

SEQ ID NO: 3976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucagcaaguacacagcctt

SEQ ID NO: 3977 - RNA, 19 nt, Artificial Sequence
  source: /note="Description of Artificial Sequence: Synthetic oligonucleotide"
uacuucucggccagcccau

SEQ ID NO: 3978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuucucggccagcccautt

SEQ ID NO: 3979 - RNA, 19 nt, Artificial Sequence
  source: /note="Description of Artificial Sequence: Synthetic oligonucleotide"
augggcuggccgagaagua

SEQ ID NO: 3980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augggcuggccgagaaguatt

SEQ ID NO: 3981 - RNA, 19 nt, Artificial Sequence
  source: /note="Description of Artificial Sequence: Synthetic oligonucleotide"
gcccaucuucccuggggac

SEQ ID NO: 3982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaucuucccuggggactt

SEQ ID NO: 3983 - RNA, 19 nt, Artificial Sequence
  source: /note="Description of Artificial Sequence: Synthetic oligonucleotide"
guccccagggaagaugggc

SEQ ID NO: 3984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccccagggaagaugggctt

SEQ ID NO: 3985 - RNA, 19 nt, Artificial Sequence
  source: /note="Description of Artificial Sequence: Synthetic oligonucleotide"
cuggggacaguggggugga

SEQ ID NO: 3986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggacagugggguggatt

SEQ ID NO: 3987 - RNA, 19 nt, Artificial Sequence
  source: /note="Description of Artificial Sequence: Synthetic oligonucleotide"
uccaccccacuguccccag

SEQ ID NO: 3988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaccccacuguccccagtt

SEQ ID NO: 3989 - RNA, 19 nt, Artificial Sequence
  source: /note="Description of Artificial Sequence: Synthetic oligonucleotide"
uccuggugaacuguccauc

SEQ ID NO: 3990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuggugaacuguccauctt

SEQ ID NO: 3991 - RNA, 19 nt, Artificial Sequence
  source: /note="Description of Artificial Sequence: Synthetic oligonucleotide"
gauggacaguucaccagga

SEQ ID NO: 3992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggacaguucaccaggatt

SEQ ID NO: 3993 - RNA, 19 nt, Artificial Sequence
  source: /note="Description of Artificial Sequence: Synthetic oligonucleotide"
ccuggugaacuguccaucc

SEQ ID NO: 3994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggugaacuguccaucctt

SEQ ID NO: 3995 - RNA, 19 nt, Artificial Sequence
  source: /note="Description of Artificial Sequence: Synthetic oligonucleotide"
ggauggacaguucaccagg

SEQ ID NO: 3996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauggacaguucaccaggtt

SEQ ID NO: 3997 - RNA, 19 nt, Artificial Sequence
  source: /note="Description of Artificial Sequence: Synthetic oligonucleotide"
uagcucuuccugagggccc

SEQ ID NO: 3998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcucuuccugagggccctt

SEQ ID NO: 3999 - RNA, 19 nt, Artificial Sequence
  source: /note="Description of Artificial Sequence: Synthetic oligonucleotide"
gggcccucaggaagagcua

SEQ ID NO: 4000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcccucaggaagagcuatt

SEQ ID NO: 4001 - RNA, 19 nt, Artificial Sequence
  source: /note="Description of Artificial Sequence: Synthetic oligonucleotide"
agcucuuccugagggcccc

SEQ ID NO: 4002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucuuccugagggcccctt

SEQ ID NO: 4003 - RNA, 19 nt, Artificial Sequence
  source: /note="Description of Artificial Sequence: Synthetic oligonucleotide"
ggggcccucaggaagagcu

SEQ ID NO: 4004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcccucaggaagagcutt

SEQ ID NO: 4005 - RNA, 19 nt, Artificial Sequence
  source: /note="Description of Artificial Sequence: Synthetic oligonucleotide"
cucagcagccuaaccucug

SEQ ID NO: 4006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucagcagccuaaccucugtt

SEQ ID NO: 4007 - RNA, 19 nt, Artificial Sequence
  source: /note="Description of Artificial Sequence: Synthetic oligonucleotide"
cagagguuaggcugcugag

SEQ ID NO: 4008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagguuaggcugcugagtt

SEQ ID NO: 4009 - RNA, 19 nt, Artificial Sequence
  source: /note="Description of Artificial Sequence: Synthetic oligonucleotide"
uccuucccucccccccucu

SEQ ID NO: 4010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuucccucccccccucutt

SEQ ID NO: 4011 - RNA, 19 nt, Artificial Sequence
  source: /note="Description of Artificial Sequence: Synthetic oligonucleotide"
agagggggggagggaagga

SEQ ID NO: 4012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagggggggagggaaggatt

SEQ ID NO: 4013 - RNA, 19 nt, Artificial Sequence
  source: /note="Description of Artificial Sequence: Synthetic oligonucleotide"
ucucccaggucccuuguaa

SEQ ID NO: 4014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucccaggucccuuguaatt

SEQ ID NO: 4015 - RNA, 19 nt, Artificial Sequence
  source: /note="Description of Artificial Sequence: Synthetic oligonucleotide"
uuacaagggaccugggaga

SEQ ID NO: 4016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacaagggaccugggagatt

SEQ ID NO: 4017 - RNA, 19 nt, Artificial Sequence
  source: /note="Description of Artificial Sequence: Synthetic oligonucleotide"
uauaauuuuuucuuaaaga

SEQ ID NO: 4018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaauuuuuucuuaaagatt

SEQ ID NO: 4019 - RNA, 19 nt, Artificial Sequence
  source: /note="Description of Artificial Sequence: Synthetic oligonucleotide"
ucuuuaagaaaaaauuaua

SEQ ID NO: 4020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuuaagaaaaaauuauatt

SEQ ID NO: 4021 - RNA, 19 nt, Artificial Sequence
  source: /note="Description of Artificial Sequence: Synthetic oligonucleotide"
uuuuuucuuaaagaaaacg

SEQ ID NO: 4022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuuucuuaaagaaaacgtt

SEQ ID NO: 4023 - RNA, 19 nt, Artificial Sequence
  source: /note="Description of Artificial Sequence: Synthetic oligonucleotide"
cguuuucuuuaagaaaaaa

SEQ ID NO: 4024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguuuucuuuaagaaaaaatt

SEQ ID NO: 4025 - RNA, 19 nt, Artificial Sequence
  source: /note="Description of Artificial Sequence: Synthetic oligonucleotide"
gcucccaaggcuuccuccc

SEQ ID NO: 4026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucccaaggcuuccuccctt

SEQ ID NO: 4027 - RNA, 19 nt, Artificial Sequence
  source: /note="Description of Artificial Sequence: Synthetic oligonucleotide"
gggaggaagccuugggagc

SEQ ID NO: 4028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggaagccuugggagctt

SEQ ID NO: 4029 - RNA, 19 nt, Artificial Sequence
  source: /note="Description of Artificial Sequence: Synthetic oligonucleotide"
aggcuuccucccucucccc

SEQ ID NO: 4030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuuccucccucucccctt

SEQ ID NO: 4031 - RNA, 19 nt, Artificial Sequence
  source: /note="Description of Artificial Sequence: Synthetic oligonucleotide"
ggggagagggaggaagccu

SEQ ID NO: 4032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagagggaggaagccutt

SEQ ID NO: 4033 - RNA, 19 nt, Artificial Sequence
  source: /note="Description of Artificial Sequence: Synthetic oligonucleotide"
ggcuuccucccucucccca

SEQ ID NO: 4034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuuccucccucuccccatt

SEQ ID NO: 4035 - RNA, 19 nt, Artificial Sequence
  source: /note="Description of Artificial Sequence: Synthetic oligonucleotide"
uggggagagggaggaagcc

SEQ ID NO: 4036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggagagggaggaagcctt

SEQ ID NO: 4037 - RNA, 19 nt, Artificial Sequence
  source: /note="Description of Artificial Sequence: Synthetic oligonucleotide"
ucuccccauccuggaagga

SEQ ID NO: 4038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccccauccuggaaggatt

SEQ ID NO: 4039 - RNA, 19 nt, Artificial Sequence
  source: /note="Description of Artificial Sequence: Synthetic oligonucleotide"
uccuuccaggauggggaga

SEQ ID NO: 4040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuccaggauggggagatt

SEQ ID NO: 4041 - RNA, 19 nt, Artificial Sequence
  source: /note="Description of Artificial Sequence: Synthetic oligonucleotide"
uaggccaaggcccagagcg

SEQ ID NO: 4042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggccaaggcccagagcgtt

SEQ ID NO: 4043 - RNA, 19 nt, Artificial Sequence
  source: /note="Description of Artificial Sequence: Synthetic oligonucleotide"
cgcucugggccuuggccua

SEQ ID NO: 4044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcucugggccuuggccuatt

SEQ ID NO: 4045 - RNA, 19 nt, Artificial Sequence
  source: /note="Description of Artificial Sequence: Synthetic oligonucleotide"
gauuaugcguaagcuggac

SEQ ID NO: 4046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuaugcguaagcuggactt

SEQ ID NO: 4047 - RNA, 19 nt, Artificial Sequence
  source: /note="Description of Artificial Sequence: Synthetic oligonucleotide"
guccagcuuacgcauaauc

SEQ ID NO: 4048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccagcuuacgcauaauctt

SEQ ID NO: 4049 - RNA, 19 nt, Artificial Sequence
  source: /note="Description of Artificial Sequence: Synthetic oligonucleotide"
ugcguaagcuggaccacug

SEQ ID NO: 4050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcguaagcuggaccacugtt

SEQ ID NO: 4051 - RNA, 19 nt, Artificial Sequence
  source: /note="Description of Artificial Sequence: Synthetic oligonucleotide"
cagugguccagcuuacgca

SEQ ID NO: 4052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugguccagcuuacgcatt

SEQ ID NO: 4053 - RNA, 19 nt, Artificial Sequence
  source: /note="Description of Artificial Sequence: Synthetic oligonucleotide"
uguaccgaguggcccgcca

SEQ ID NO: 4054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaccgaguggcccgccatt

SEQ ID NO: 4055 - RNA, 19 nt, Artificial Sequence
  source: /note="Description of Artificial Sequence: Synthetic oligonucleotide"
uggcgggccacucgguaca

SEQ ID NO: 4056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcgggccacucgguacatt

SEQ ID NO: 4057 - RNA, 19 nt, Artificial Sequence
  source: /note="Description of Artificial Sequence: Synthetic oligonucleotide"
gacgagcuguauuugaauc

SEQ ID NO: 4058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgagcuguauuugaauctt

SEQ ID NO: 4059 - RNA, 19 nt, Artificial Sequence
  source: /note="Description of Artificial Sequence: Synthetic oligonucleotide"
gauucaaauacagcucguc

SEQ ID NO: 4060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauucaaauacagcucguctt

SEQ ID NO: 4061 - RNA, 19 nt, Artificial Sequence
  source: /note="Description of Artificial Sequence: Synthetic oligonucleotide"
ccucgcuagcucuuccuga

SEQ ID NO: 4062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucgcuagcucuuccugatt

SEQ ID NO: 4063 - RNA, 19 nt, Artificial Sequence
  source: /note="Description of Artificial Sequence: Synthetic oligonucleotide"
ucaggaagagcuagcgagg

SEQ ID NO: 4064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaggaagagcuagcgaggtt

SEQ ID NO: 4065 - RNA, 19 nt, Artificial Sequence
  source: /note="Description of Artificial Sequence: Synthetic oligonucleotide"
accgagaacugcagauuau

SEQ ID NO: 4066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgagaacugcagauuautt

SEQ ID NO: 4067 - RNA, 19 nt, Artificial Sequence
  source: /note="Description of Artificial Sequence: Synthetic oligonucleotide"
auaaucugcaguucucggu

SEQ ID NO: 4068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaaucugcaguucucggutt

SEQ ID NO: 4069 - RNA, 19 nt, Artificial Sequence
  source: /note="Description of Artificial Sequence: Synthetic oligonucleotide"
acgagcuguauuugaaucu

SEQ ID NO: 4070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgagcuguauuugaaucutt

SEQ ID NO: 4071 - RNA, 19 nt, Artificial Sequence
  source: /note="Description of Artificial Sequence: Synthetic oligonucleotide"
agauucaaauacagcucgu

SEQ ID NO: 4072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauucaaauacagcucgutt

SEQ ID NO: 4073 - RNA, 19 nt, Artificial Sequence
  source: /note="Description of Artificial Sequence: Synthetic oligonucleotide"
ucaccccuaucaucuacau

SEQ ID NO: 4074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccccuaucaucuacautt

SEQ ID NO: 4075 - RNA, 19 nt, Artificial Sequence
  source: /note="Description of Artificial Sequence: Synthetic oligonucleotide"
auguagaugauagggguga

SEQ ID NO: 4076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguagaugauaggggugatt

SEQ ID NO: 4077 - RNA, 19 nt, Artificial Sequence
  source: /note="Description of Artificial Sequence: Synthetic oligonucleotide"
ucuucgaugaacugcggag

SEQ ID NO: 4078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucgaugaacugcggagtt

SEQ ID NO: 4079 - RNA, 19 nt, Artificial Sequence
  source: /note="Description of Artificial Sequence: Synthetic oligonucleotide"
cuccgcaguucaucgaaga

SEQ ID NO: 4080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgcaguucaucgaagatt

SEQ ID NO: 4081 - RNA, 19 nt, Artificial Sequence
  source: /note="Description of Artificial Sequence: Synthetic oligonucleotide"
agagagucccuggugucuu

SEQ ID NO: 4082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagagucccuggugucuutt

SEQ ID NO: 4083 - RNA, 19 nt, Artificial Sequence
  source: /note="Description of Artificial Sequence: Synthetic oligonucleotide"
aagacaccagggacucucu

SEQ ID NO: 4084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagacaccagggacucucutt

SEQ ID NO: 4085 - RNA, 19 nt, Artificial Sequence
  source: /note="Description of Artificial Sequence: Synthetic oligonucleotide"
acggcagagggacuucauc

SEQ ID NO: 4086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggcagagggacuucauctt

SEQ ID NO: 4087 - RNA, 19 nt, Artificial Sequence
  source: /note="Description of Artificial Sequence: Synthetic oligonucleotide"
gaugaagucccucugccgu

SEQ ID NO: 4088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaagucccucugccgutt

SEQ ID NO: 4089 - RNA, 19 nt, Artificial Sequence
  source: /note="Description of Artificial Sequence: Synthetic oligonucleotide"
cccgaacggcgcggccugg

SEQ ID NO: 4090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgaacggcgcggccuggtt

SEQ ID NO: 4091 - RNA, 19 nt, Artificial Sequence
  source: /note="Description of Artificial Sequence: Synthetic oligonucleotide"
ccaggccgcgccguucggg

SEQ ID NO: 4092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggccgcgccguucgggtt

SEQ ID NO: 4093 - RNA, 19 nt, Artificial Sequence
  source: /note="Description of Artificial Sequence: Synthetic oligonucleotide"
ggcgccaugagcggcggcg

SEQ ID NO: 4094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgccaugagcggcggcgtt

SEQ ID NO: 4095 - RNA, 19 nt, Artificial Sequence
  source: /note="Description of Artificial Sequence: Synthetic oligonucleotide"
cgccgccgcucauggcgcc

SEQ ID NO: 4096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgccgcucauggcgcctt

SEQ ID NO: 4097 - RNA, 19 nt, Artificial Sequence
  source: /note="Description of Artificial Sequence: Synthetic oligonucleotide"
gcgccaugagcggcggcgg

SEQ ID NO: 4098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgccaugagcggcggcggtt

SEQ ID NO: 4099 - RNA, 19 nt, Artificial Sequence
  source: /note="Description of Artificial Sequence: Synthetic oligonucleotide"
ccgccgccgcucauggcgc

SEQ ID NO: 4100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgccgcucauggcgctt

SEQ ID NO: 4101 - RNA, 19 nt, Artificial Sequence
  source: /note="Description of Artificial Sequence: Synthetic oligonucleotide"
gcgggaaagcgucagucgg

SEQ ID NO: 4102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggaaagcgucagucggtt

SEQ ID NO: 4103 - RNA, 19 nt, Artificial Sequence
  source: /note="Description of Artificial Sequence: Synthetic oligonucleotide"
ccgacugacgcuuucccgc

SEQ ID NO: 4104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgacugacgcuuucccgctt

SEQ ID NO: 4105 - RNA, 19 nt, Artificial Sequence
  source: /note="Description of Artificial Sequence: Synthetic oligonucleotide"
ucggggcuauggguggggg

SEQ ID NO: 4106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggggcuaugggugggggtt

SEQ ID NO: 4107 - RNA, 19 nt, Artificial Sequence
  source: /note="Description of Artificial Sequence: Synthetic oligonucleotide"
cccccacccauagccccga

SEQ ID NO: 4108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccacccauagccccgatt

SEQ ID NO: 4109 - RNA, 19 nt, Artificial Sequence
  source: /note="Description of Artificial Sequence: Synthetic oligonucleotide"
cgccgccgggagugaagcu

SEQ ID NO: 4110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgccgggagugaagcutt

SEQ ID NO: 4111 - RNA, 19 nt, Artificial Sequence
  source: /note="Description of Artificial Sequence: Synthetic oligonucleotide"
agcuucacucccggcggcg

SEQ ID NO: 4112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuucacucccggcggcgtt

SEQ ID NO: 4113 - RNA, 19 nt, Artificial Sequence
  source: /note="Description of Artificial Sequence: Synthetic oligonucleotide"
ugacagcgggaaggugacc

SEQ ID NO: 4114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacagcgggaaggugacctt

SEQ ID NO: 4115 - RNA, 19 nt, Artificial Sequence
  source: /note="Description of Artificial Sequence: Synthetic oligonucleotide"
ggucaccuucccgcuguca

SEQ ID NO: 4116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucaccuucccgcugucatt

SEQ ID NO: 4117 - RNA, 19 nt, Artificial Sequence
  source: /note="Description of Artificial Sequence: Synthetic oligonucleotide"
agcgggaaggugaccacag

SEQ ID NO: 4118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgggaaggugaccacagtt

SEQ ID NO: 4119 - RNA, 19 nt, Artificial Sequence
  source: /note="Description of Artificial Sequence: Synthetic oligonucleotide"
cuguggucaccuucccgcu

SEQ ID NO: 4120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggucaccuucccgcutt

SEQ ID NO: 4121 - RNA, 19 nt, Artificial Sequence
  source: /note="Description of Artificial Sequence: Synthetic oligonucleotide"
gcgggaaggugaccacagu

SEQ ID NO: 4122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggaaggugaccacagutt

SEQ ID NO: 4123 - RNA, 19 nt, Artificial Sequence
  source: /note="Description of Artificial Sequence: Synthetic oligonucleotide"
acuguggucaccuucccgc

SEQ ID NO: 4124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguggucaccuucccgctt

SEQ ID NO: 4125 - RNA, 19 nt, Artificial Sequence
  source: /note="Description of Artificial Sequence: Synthetic oligonucleotide"
caaggcccagagcguuccc

SEQ ID NO: 4126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggcccagagcguuccctt

SEQ ID NO: 4127 - RNA, 19 nt, Artificial Sequence
  source: /note="Description of Artificial Sequence: Synthetic oligonucleotide"
gggaacgcucugggccuug

SEQ ID NO: 4128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaacgcucugggccuugtt

SEQ ID NO: 4129 - RNA, 19 nt, Artificial Sequence
  source: /note="Description of Artificial Sequence: Synthetic oligonucleotide"
uaguauaccaggcacggcu

SEQ ID NO: 4130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguauaccaggcacggcutt

SEQ ID NO: 4131 - RNA, 19 nt, Artificial Sequence
  source: /note="Description of Artificial Sequence: Synthetic oligonucleotide"
agccgugccugguauacua

SEQ ID NO: 4132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccgugccugguauacuatt

SEQ ID NO: 4133 - RNA, 19 nt, Artificial Sequence
  source: /note="Description of Artificial Sequence: Synthetic oligonucleotide"
agagacgagggaacuggug

SEQ ID NO: 4134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagacgagggaacuggugtt

SEQ ID NO: 4135 - RNA, 19 nt, Artificial Sequence
  source: /note="Description of Artificial Sequence: Synthetic oligonucleotide"
caccaguucccucgucucu

SEQ ID NO: 4136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaguucccucgucucutt

SEQ ID NO: 4137 - RNA, 19 nt, Artificial Sequence
  source: /note="Description of Artificial Sequence: Synthetic oligonucleotide"
gaaccgagaacugcagauu

SEQ ID NO: 4138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccgagaacugcagauutt

SEQ ID NO: 4139 - RNA, 19 nt, Artificial Sequence
  source: /note="Description of Artificial Sequence: Synthetic oligonucleotide"
aaucugcaguucucgguuc

SEQ ID NO: 4140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucugcaguucucgguuctt

SEQ ID NO: 4141 - RNA, 19 nt, Artificial Sequence
  source: /note="Description of Artificial Sequence: Synthetic oligonucleotide"
auuaugcguaagcuggacc

SEQ ID NO: 4142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuaugcguaagcuggacctt

SEQ ID NO: 4143 - RNA, 19 nt, Artificial Sequence
  source: /note="Description of Artificial Sequence: Synthetic oligonucleotide"
gguccagcuuacgcauaau

SEQ ID NO: 4144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccagcuuacgcauaautt

SEQ ID NO: 4145 - RNA, 19 nt, Artificial Sequence
  source: /note="Description of Artificial Sequence: Synthetic oligonucleotide"
uuaugcguaagcuggacca

SEQ ID NO: 4146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaugcguaagcuggaccatt

SEQ ID NO: 4147 - RNA, 19 nt, Artificial Sequence
  source: /note="Description of Artificial Sequence: Synthetic oligonucleotide"
ugguccagcuuacgcauaa

SEQ ID NO: 4148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguccagcuuacgcauaatt

SEQ ID NO: 4149 - RNA, 19 nt, Artificial Sequence
  source: /note="Description of Artificial Sequence: Synthetic oligonucleotide"
uaugcguaagcuggaccac

SEQ ID NO: 4150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaugcguaagcuggaccactt

SEQ ID NO: 4151 - RNA, 19 nt, Artificial Sequence
  source: /note="Description of Artificial Sequence: Synthetic oligonucleotide"
gugguccagcuuacgcaua

SEQ ID NO: 4152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguccagcuuacgcauatt

SEQ ID NO: 4153 - RNA, 19 nt, Artificial Sequence
  source: /note="Description of Artificial Sequence: Synthetic oligonucleotide"
gcguaagcuggaccacugc

SEQ ID NO: 4154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcguaagcuggaccacugctt

SEQ ID NO: 4155 - RNA, 19 nt, Artificial Sequence
  source: /note="Description of Artificial Sequence: Synthetic oligonucleotide"
gcagugguccagcuuacgc

SEQ ID NO: 4156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagugguccagcuuacgctt

SEQ ID NO: 4157 - RNA, 19 nt, Artificial Sequence
  source: /note="Description of Artificial Sequence: Synthetic oligonucleotide"
cugcgguacuuuuucuacu

SEQ ID NO: 4158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcgguacuuuuucuacutt

SEQ ID NO: 4159 - RNA, 19 nt, Artificial Sequence
  source: /note="Description of Artificial Sequence: Synthetic oligonucleotide"
aguagaaaaaguaccgcag

SEQ ID NO: 4160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguagaaaaaguaccgcagtt

SEQ ID NO: 4161 - RNA, 19 nt, Artificial Sequence
  source: /note="Description of Artificial Sequence: Synthetic oligonucleotide"
ugcgguacuuuuucuacuc

SEQ ID NO: 4162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcgguacuuuuucuacuctt

SEQ ID NO: 4163 - RNA, 19 nt, Artificial Sequence
  source: /note="Description of Artificial Sequence: Synthetic oligonucleotide"
gaguagaaaaaguaccgca

SEQ ID NO: 4164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguagaaaaaguaccgcatt

SEQ ID NO: 4165 - RNA, 19 nt, Artificial Sequence
  source: /note="Description of Artificial Sequence: Synthetic oligonucleotide"
agcuguauuugaaucuggu

SEQ ID NO: 4166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuguauuugaaucuggutt

SEQ ID NO: 4167 - RNA, 19 nt, Artificial Sequence
  source: /note="Description of Artificial Sequence: Synthetic oligonucleotide"
accagauucaaauacagcu

SEQ ID NO: 4168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagauucaaauacagcutt

SEQ ID NO: 4169 - RNA, 19 nt, Artificial Sequence
  source: /note="Description of Artificial Sequence: Synthetic oligonucleotide"
guguaccgaguggcccgcc

SEQ ID NO: 4170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguaccgaguggcccgcctt

SEQ ID NO: 4171 - RNA, 19 nt, Artificial Sequence
  source: /note="Description of Artificial Sequence: Synthetic oligonucleotide"
ggcgggccacucgguacac

SEQ ID NO: 4172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggccacucgguacactt

SEQ ID NO: 4173 - RNA, 19 nt, Artificial Sequence
  source: /note="Description of Artificial Sequence: Synthetic oligonucleotide"
guaccgaguggcccgccac

SEQ ID NO: 4174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccgaguggcccgccactt

SEQ ID NO: 4175 - RNA, 19 nt, Artificial Sequence
  source: /note="Description of Artificial Sequence: Synthetic oligonucleotide"
guggcgggccacucgguac

SEQ ID NO: 4176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcgggccacucgguactt

SEQ ID NO: 4177 - RNA, 19 nt, Artificial Sequence
  source: /note="Description of Artificial Sequence: Synthetic oligonucleotide"
accgaguggcccgccacuu

SEQ ID NO: 4178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgaguggcccgccacuutt

SEQ ID NO: 4179 - RNA, 19 nt, Artificial Sequence
  source: /note="Description of Artificial Sequence: Synthetic oligonucleotide"
aaguggcgggccacucggu

SEQ ID NO: 4180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguggcgggccacucggutt

SEQ ID NO: 4181 - RNA, 19 nt, Artificial Sequence
  source: /note="Description of Artificial Sequence: Synthetic oligonucleotide"
ccgaguggcccgccacuuc

SEQ ID NO: 4182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaguggcccgccacuuctt

SEQ ID NO: 4183 - RNA, 19 nt, Artificial Sequence
  source: /note="Description of Artificial Sequence: Synthetic oligonucleotide"
gaaguggcgggccacucgg

SEQ ID NO: 4184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaguggcgggccacucggtt

SEQ ID NO: 4185 - RNA, 19 nt, Artificial Sequence
  source: /note="Description of Artificial Sequence: Synthetic oligonucleotide"
aucaccccuaucaucuaca

SEQ ID NO: 4186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaccccuaucaucuacatt

SEQ ID NO: 4187 - RNA, 19 nt, Artificial Sequence
  source: /note="Description of Artificial Sequence: Synthetic oligonucleotide"
uguagaugauaggggugau

SEQ ID NO: 4188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguagaugauaggggugautt

SEQ ID NO: 4189 - RNA, 19 nt, Artificial Sequence
  source: /note="Description of Artificial Sequence: Synthetic oligonucleotide"
caucuacaucaagguguac

SEQ ID NO: 4190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuacaucaagguguactt

SEQ ID NO: 4191 - RNA, 19 nt, Artificial Sequence
  source: /note="Description of Artificial Sequence: Synthetic oligonucleotide"
guacaccuugauguagaug

SEQ ID NO: 4192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacaccuugauguagaugtt

SEQ ID NO: 4193 - RNA, 19 nt, Artificial Sequence
  source: /note="Description of Artificial Sequence: Synthetic oligonucleotide"
acaucaagguguacaugua

SEQ ID NO: 4194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucaagguguacauguatt

SEQ ID NO: 4195 - RNA, 19 nt, Artificial Sequence
  source: /note="Description of Artificial Sequence: Synthetic oligonucleotide"
uacauguacaccuugaugu

SEQ ID NO: 4196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacauguacaccuugaugutt

SEQ ID NO: 4197 - RNA, 19 nt, Artificial Sequence
  source: /note="Description of Artificial Sequence: Synthetic oligonucleotide"
uuggccuacauccacuccc

SEQ ID NO: 4198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggccuacauccacuccctt

SEQ ID NO: 4199 - RNA, 19 nt, Artificial Sequence
  source: /note="Description of Artificial Sequence: Synthetic oligonucleotide"
gggaguggauguaggccaa

SEQ ID NO: 4200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaguggauguaggccaatt

SEQ ID NO: 4201 - RNA, 19 nt, Artificial Sequence
  source: /note="Description of Artificial Sequence: Synthetic oligonucleotide"
cuacauccacucccaaggu

SEQ ID NO: 4202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacauccacucccaaggutt

SEQ ID NO: 4203 - RNA, 19 nt, Artificial Sequence
  source: /note="Description of Artificial Sequence: Synthetic oligonucleotide"
accuugggaguggauguag

SEQ ID NO: 4204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuugggaguggauguagtt

SEQ ID NO: 4205 - RNA, 19 nt, Artificial Sequence
  source: /note="Description of Artificial Sequence: Synthetic oligonucleotide"
gacaucaagccccagaauu

SEQ ID NO: 4206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaucaagccccagaauutt

SEQ ID NO: 4207 - RNA, 19 nt, Artificial Sequence
  source: /note="Description of Artificial Sequence: Synthetic oligonucleotide"
aauucuggggcuugauguc

SEQ ID NO: 4208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucuggggcuugauguctt

SEQ ID NO: 4209 - RNA, 19 nt, Artificial Sequence
  source: /note="Description of Artificial Sequence: Synthetic oligonucleotide"
agaauuugcuuguggaccc

SEQ ID NO: 4210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaauuugcuuguggaccctt

SEQ ID NO: 4211 - RNA, 19 nt, Artificial Sequence
  source: /note="Description of Artificial Sequence: Synthetic oligonucleotide"
ggguccacaagcaaauucu

SEQ ID NO: 4212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguccacaagcaaauucutt

SEQ ID NO: 4213 - RNA, 19 nt, Artificial Sequence
  source: /note="Description of Artificial Sequence: Synthetic oligonucleotide"
ugcucucgguacuaccgug

SEQ ID NO: 4214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcucucgguacuaccgugtt

SEQ ID NO: 4215 - RNA, 19 nt, Artificial Sequence
  source: /note="Description of Artificial Sequence: Synthetic oligonucleotide"
cacgguaguaccgagagca

SEQ ID NO: 4216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacgguaguaccgagagcatt

SEQ ID NO: 4217 - RNA, 19 nt, Artificial Sequence
  source: /note="Description of Artificial Sequence: Synthetic oligonucleotide"
gcucucgguacuaccgugc

SEQ ID NO: 4218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucucgguacuaccgugctt

SEQ ID NO: 4219 - RNA, 19 nt, Artificial Sequence
  source: /note="Description of Artificial Sequence: Synthetic oligonucleotide"
gcacgguaguaccgagagc

SEQ ID NO: 4220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacgguaguaccgagagctt

SEQ ID NO: 4221 - RNA, 19 nt, Artificial Sequence
  source: /note="Description of Artificial Sequence: Synthetic oligonucleotide"
acaccucguccaucgaugu

SEQ ID NO: 4222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccucguccaucgaugutt

SEQ ID NO: 4223 - RNA, 19 nt, Artificial Sequence
  source: /note="Description of Artificial Sequence: Synthetic oligonucleotide"
acaucgauggacgaggugu

SEQ ID NO: 4224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucgauggacgaggugutt

SEQ ID NO: 4225 - RNA, 19 nt, Artificial Sequence
  source: /note="Description of Artificial Sequence: Synthetic oligonucleotide"
caccucguccaucgaugug

SEQ ID NO: 4226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccucguccaucgaugugtt

SEQ ID NO: 4227 - RNA, 19 nt, Artificial Sequence
  source: /note="Description of Artificial Sequence: Synthetic oligonucleotide"
cacaucgauggacgaggug

SEQ ID NO: 4228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaucgauggacgaggugtt

SEQ ID NO: 4229 - RNA, 19 nt, Artificial Sequence
  source: /note="Description of Artificial Sequence: Synthetic oligonucleotide"
accucguccaucgaugugu

SEQ ID NO: 4230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucguccaucgaugugutt

SEQ ID NO: 4231 - RNA, 19 nt, Artificial Sequence
  source: /note="Description of Artificial Sequence: Synthetic oligonucleotide"
acacaucgauggacgaggu

SEQ ID NO: 4232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacaucgauggacgaggutt

SEQ ID NO: 4233 - RNA, 19 nt, Artificial Sequence
  source: /note="Description of Artificial Sequence: Synthetic oligonucleotide"
cuauacggaguucaaguuc

SEQ ID NO: 4234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauacggaguucaaguuctt

SEQ ID NO: 4235 - RNA, 19 nt, Artificial Sequence
  source: /note="Description of Artificial Sequence: Synthetic oligonucleotide"
gaacuugaacuccguauag

SEQ ID NO: 4236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuugaacuccguauagtt

SEQ ID NO: 4237 - RNA, 19 nt, Artificial Sequence
  source: /note="Description of Artificial Sequence: Synthetic oligonucleotide"
uauacggaguucaaguucc

SEQ ID NO: 4238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacggaguucaaguucctt

SEQ ID NO: 4239 - RNA, 19 nt, Artificial Sequence
  source: /note="Description of Artificial Sequence: Synthetic oligonucleotide"
ggaacuugaacuccguaua

SEQ ID NO: 4240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacuugaacuccguauatt

SEQ ID NO: 4241 - RNA, 19 nt, Artificial Sequence
  source: /note="Description of Artificial Sequence: Synthetic oligonucleotide"
auacggaguucaaguuccc

SEQ ID NO: 4242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacggaguucaaguuccctt

SEQ ID NO: 4243 - RNA, 19 nt, Artificial Sequence
  source: /note="Description of Artificial Sequence: Synthetic oligonucleotide"
gggaacuugaacuccguau

SEQ ID NO: 4244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaacuugaacuccguautt

SEQ ID NO: 4245 - RNA, 19 nt, Artificial Sequence
  source: /note="Description of Artificial Sequence: Synthetic oligonucleotide"
gcuucuucgaugaacugcg

SEQ ID NO: 4246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucuucgaugaacugcgtt

SEQ ID NO: 4247 - RNA, 19 nt, Artificial Sequence
  source: /note="Description of Artificial Sequence: Synthetic oligonucleotide"
cgcaguucaucgaagaagc

SEQ ID NO: 4248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcaguucaucgaagaagctt

SEQ ID NO: 4249 - RNA, 19 nt, Artificial Sequence
  source: /note="Description of Artificial Sequence: Synthetic oligonucleotide"
cuucuucgaugaacugcgg

SEQ ID NO: 4250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuucgaugaacugcggtt

SEQ ID NO: 4251 - RNA, 19 nt, Artificial Sequence
  source: /note="Description of Artificial Sequence: Synthetic oligonucleotide"
ccgcaguucaucgaagaag

SEQ ID NO: 4252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcaguucaucgaagaagtt

SEQ ID NO: 4253 - RNA, 19 nt, Artificial Sequence
  source: /note="Description of Artificial Sequence: Synthetic oligonucleotide"
uucuucgaugaacugcgga

SEQ ID NO: 4254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuucgaugaacugcggatt

SEQ ID NO: 4255 - RNA, 19 nt, Artificial Sequence
  source: /note="Description of Artificial Sequence: Synthetic oligonucleotide"
uccgcaguucaucgaagaa

SEQ ID NO: 4256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgcaguucaucgaagaatt

SEQ ID NO: 4257 - RNA, 19 nt, Artificial Sequence
  source: /note="Description of Artificial Sequence: Synthetic oligonucleotide"
cuucgaugaacugcggaga

SEQ ID NO: 4258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucgaugaacugcggagatt

SEQ ID NO: 4259 - RNA, 19 nt, Artificial Sequence
  source: /note="Description of Artificial Sequence: Synthetic oligonucleotide"
ucuccgcaguucaucgaag

SEQ ID NO: 4260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccgcaguucaucgaagtt

SEQ ID NO: 4261 - RNA, 19 nt, Artificial Sequence
  source: /note="Description of Artificial Sequence: Synthetic oligonucleotide"
cccccccuguucaacuuca

SEQ ID NO: 4262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccccuguucaacuucatt

SEQ ID NO: 4263 - RNA, 19 nt, Artificial Sequence
  source: /note="Description of Artificial Sequence: Synthetic oligonucleotide"
ugaaguugaacaggggggg

SEQ ID NO: 4264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaguugaacagggggggtt

SEQ ID NO: 4265 - RNA, 19 nt, Artificial Sequence
  source: /note="Description of Artificial Sequence: Synthetic oligonucleotide"
cauccucacaagcuuuaac

SEQ ID NO: 4266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccucacaagcuuuaactt

SEQ ID NO: 4267 - RNA, 19 nt, Artificial Sequence
  source: /note="Description of Artificial Sequence: Synthetic oligonucleotide"
guuaaagcuugugaggaug

SEQ ID NO: 4268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaaagcuugugaggaugtt

SEQ ID NO: 4269 - RNA, 19 nt, Artificial Sequence
  source: /note="Description of Artificial Sequence: Synthetic oligonucleotide"
cacaacugcuacccucgcu

SEQ ID NO: 4270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaacugcuacccucgcutt

SEQ ID NO: 4271 - RNA, 19 nt, Artificial Sequence
  source: /note="Description of Artificial Sequence: Synthetic oligonucleotide"
agcgaggguagcaguugug

SEQ ID NO: 4272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgaggguagcaguugugtt

SEQ ID NO: 4273 - RNA, 19 nt, Artificial Sequence
  source: /note="Description of Artificial Sequence: Synthetic oligonucleotide"
acaacugcuacccucgcua

SEQ ID NO: 4274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaacugcuacccucgcuatt

SEQ ID NO: 4275 - RNA, 19 nt, Artificial Sequence
  source: /note="Description of Artificial Sequence: Synthetic oligonucleotide"
uagcgaggguagcaguugu

SEQ ID NO: 4276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcgaggguagcaguugutt

SEQ ID NO: 4277 - RNA, 19 nt, Artificial Sequence
  source: /note="Description of Artificial Sequence: Synthetic oligonucleotide"
uacccucgcuagcucuucc

SEQ ID NO: 4278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacccucgcuagcucuucctt

SEQ ID NO: 4279 - RNA, 19 nt, Artificial Sequence
  source: /note="Description of Artificial Sequence: Synthetic oligonucleotide"
ggaagagcuagcgagggua

SEQ ID NO: 4280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagagcuagcgaggguatt

SEQ ID NO: 4281 - RNA, 19 nt, Artificial Sequence
  source: /note="Description of Artificial Sequence: Synthetic oligonucleotide"
cccucgcuagcucuuccug

SEQ ID NO: 4282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucgcuagcucuuccugtt

SEQ ID NO: 4283 - RNA, 19 nt, Artificial Sequence
  source: /note="Description of Artificial Sequence: Synthetic oligonucleotide"
caggaagagcuagcgaggg

SEQ ID NO: 4284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaagagcuagcgagggtt

SEQ ID NO: 4285 - RNA, 19 nt, Artificial Sequence
  source: /note="Description of Artificial Sequence: Synthetic oligonucleotide"
ccugagggccccaccgacu

SEQ ID NO: 4286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugagggccccaccgacutt

SEQ ID NO: 4287 - RNA, 19 nt, Artificial Sequence
  source: /note="Description of Artificial Sequence: Synthetic oligonucleotide"
agucgguggggcccucagg

SEQ ID NO: 4288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucgguggggcccucaggtt

SEQ ID NO: 4289 - RNA, 19 nt, Artificial Sequence
  source: /note="Description of Artificial Sequence: Synthetic oligonucleotide"
agggccccaccgacuaccc

SEQ ID NO: 4290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggccccaccgacuaccctt

SEQ ID NO: 4291 - RNA, 19 nt, Artificial Sequence
  source: /note="Description of Artificial Sequence: Synthetic oligonucleotide"
ggguagucgguggggcccu

SEQ ID NO: 4292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguagucgguggggcccutt

SEQ ID NO: 4293 - RNA, 19 nt, Artificial Sequence
  source: /note="Description of Artificial Sequence: Synthetic oligonucleotide"
gggccccaccgacuacccc

SEQ ID NO: 4294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccccaccgacuacccctt

SEQ ID NO: 4295 - RNA, 19 nt, Artificial Sequence
  source: /note="Description of Artificial Sequence: Synthetic oligonucleotide"
gggguagucgguggggccc

SEQ ID NO: 4296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguagucgguggggccctt

SEQ ID NO: 4297 - RNA, 19 nt, Artificial Sequence
  source: /note="Description of Artificial Sequence: Synthetic oligonucleotide"
gcagccuaaccucuguggu

SEQ ID NO: 4298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagccuaaccucuguggutt

SEQ ID NO: 4299 - RNA, 19 nt, Artificial Sequence
  source: /note="Description of Artificial Sequence: Synthetic oligonucleotide"
accacagagguuaggcugc

SEQ ID NO: 4300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacagagguuaggcugctt

SEQ ID NO: 4301 - RNA, 19 nt, Artificial Sequence
  source: /note="Description of Artificial Sequence: Synthetic oligonucleotide"
cagccuaaccucuguggug

SEQ ID NO: 4302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccuaaccucuguggugtt

SEQ ID NO: 4303 - RNA, 19 nt, Artificial Sequence
  source: /note="Description of Artificial Sequence: Synthetic oligonucleotide"
caccacagagguuaggcug

SEQ ID NO: 4304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccacagagguuaggcugtt

SEQ ID NO: 4305 - RNA, 19 nt, Artificial Sequence
  source: /note="Description of Artificial Sequence: Synthetic oligonucleotide"
caggucccuuguaaauaga

SEQ ID NO: 4306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggucccuuguaaauagatt

SEQ ID NO: 4307 - RNA, 19 nt, Artificial Sequence
  source: /note="Description of Artificial Sequence: Synthetic oligonucleotide"
ucuauuuacaagggaccug

SEQ ID NO: 4308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuauuuacaagggaccugtt

SEQ ID NO: 4309 - RNA, 19 nt, Artificial Sequence
  source: /note="Description of Artificial Sequence: Synthetic oligonucleotide"
aagguuugccuguguacag

SEQ ID NO: 4310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguuugccuguguacagtt

SEQ ID NO: 4311 - RNA, 19 nt, Artificial Sequence
  source: /note="Description of Artificial Sequence: Synthetic oligonucleotide"
cuguacacaggcaaaccuu

SEQ ID NO: 4312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguacacaggcaaaccuutt

SEQ ID NO: 4313 - RNA, 19 nt, Artificial Sequence
  source: /note="Description of Artificial Sequence: Synthetic oligonucleotide"
agguuugccuguguacaga

SEQ ID NO: 4314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguuugccuguguacagatt

SEQ ID NO: 4315 - RNA, 19 nt, Artificial Sequence
  source: /note="Description of Artificial Sequence: Synthetic oligonucleotide"
ucuguacacaggcaaaccu

SEQ ID NO: 4316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguacacaggcaaaccutt

SEQ ID NO: 4317 - RNA, 19 nt, Artificial Sequence
  source: /note="Description of Artificial Sequence: Synthetic oligonucleotide"
cagaccucuguucaauaaa

SEQ ID NO: 4318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaccucuguucaauaaatt

SEQ ID NO: 4319 - RNA, 19 nt, Artificial Sequence
  source: /note="Description of Artificial Sequence: Synthetic oligonucleotide"
uuuauugaacagaggucug

SEQ ID NO: 4320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuauugaacagaggucugtt

SEQ ID NO: 4321 - RNA, 19 nt, Artificial Sequence
  source: /note="Description of Artificial Sequence: Synthetic oligonucleotide"
ggcuuacacugacaucaaa

SEQ ID NO: 4322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuuacacugacaucaaatt

SEQ ID NO: 4323 - RNA, 19 nt, Artificial Sequence
  source: /note="Description of Artificial Sequence: Synthetic oligonucleotide"
uuugaugucaguguaagcc

SEQ ID NO: 4324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaugucaguguaagcctt

SEQ ID NO: 4325 - RNA, 19 nt, Artificial Sequence
  source: /note="Description of Artificial Sequence: Synthetic oligonucleotide"
augcguaagcuggaccacu

SEQ ID NO: 4326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augcguaagcuggaccacutt

SEQ ID NO: 4327 - RNA, 19 nt, Artificial Sequence
  source: /note="Description of Artificial Sequence: Synthetic oligonucleotide"
agugguccagcuuacgcau

SEQ ID NO: 4328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugguccagcuuacgcautt

SEQ ID NO: 4329 - RNA, 19 nt, Artificial Sequence
  source: /note="Description of Artificial Sequence: Synthetic oligonucleotide"
aggacgagcuguauuugaa

SEQ ID NO: 4330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacgagcuguauuugaatt

SEQ ID NO: 4331 - RNA, 19 nt, Artificial Sequence
  source: /note="Description of Artificial Sequence: Synthetic oligonucleotide"
uucaaauacagcucguccu

SEQ ID NO: 4332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaaauacagcucguccutt

SEQ ID NO: 4333 - RNA, 19 nt, Artificial Sequence
  source: /note="Description of Artificial Sequence: Synthetic oligonucleotide"
ggacgagcuguauuugaau

SEQ ID NO: 4334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacgagcuguauuugaautt

SEQ ID NO: 4335 - RNA, 19 nt, Artificial Sequence
  source: /note="Description of Artificial Sequence: Synthetic oligonucleotide"
auucaaauacagcucgucc

SEQ ID NO: 4336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucaaauacagcucgucctt

SEQ ID NO: 4337 - RNA, 19 nt, Artificial Sequence
  source: /note="Description of Artificial Sequence: Synthetic oligonucleotide"
cacgccauccucaaggcuc

SEQ ID NO: 4338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacgccauccucaaggcuctt

SEQ ID NO: 4339 - RNA, 19 nt, Artificial Sequence
  source: /note="Description of Artificial Sequence: Synthetic oligonucleotide"
gagccuugaggauggcgug

SEQ ID NO: 4340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccuugaggauggcgugtt

SEQ ID NO: 4341 - RNA, 19 nt, Artificial Sequence
  source: /note="Description of Artificial Sequence: Synthetic oligonucleotide"
gcuaccacuccuucccucc

SEQ ID NO: 4342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaccacuccuucccucctt

SEQ ID NO: 4343 - RNA, 19 nt, Artificial Sequence
  source: /note="Description of Artificial Sequence: Synthetic oligonucleotide"
ggagggaaggagugguagc

SEQ ID NO: 4344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagggaaggagugguagctt

SEQ ID NO: 4345 - RNA, 19 nt, Artificial Sequence
  source: /note="Description of Artificial Sequence: Synthetic oligonucleotide"
caucucucgucuucccuuc

SEQ ID NO: 4346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucucucgucuucccuuctt

SEQ ID NO: 4347 - RNA, 19 nt, Artificial Sequence
  source: /note="Description of Artificial Sequence: Synthetic oligonucleotide"
gaagggaagacgagagaug

SEQ ID NO: 4348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagggaagacgagagaugtt

SEQ ID NO: 4349 - RNA, 19 nt, Artificial Sequence
  source: /note="Description of Artificial Sequence: Synthetic oligonucleotide"
gucggggcuaugggugggg

SEQ ID NO: 4350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucggggcuauggguggggtt

SEQ ID NO: 4351 - RNA, 19 nt, Artificial Sequence
  source: /note="Description of Artificial Sequence: Synthetic oligonucleotide"
ccccacccauagccccgac

SEQ ID NO: 4352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccacccauagccccgactt

SEQ ID NO: 4353 - RNA, 19 nt, Artificial Sequence
  source: /note="Description of Artificial Sequence: Synthetic oligonucleotide"
cccggcgugccccgcggcg

SEQ ID NO: 4354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggcgugccccgcggcgtt

SEQ ID NO: 4355 - RNA, 19 nt, Artificial Sequence
  source: /note="Description of Artificial Sequence: Synthetic oligonucleotide"
cgccgcggggcacgccggg

SEQ ID NO: 4356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgcggggcacgccgggtt

SEQ ID NO: 4357 - RNA, 19 nt, Artificial Sequence
  source: /note="Description of Artificial Sequence: Synthetic oligonucleotide"
ucggcgccaugagcggcgg

SEQ ID NO: 4358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggcgccaugagcggcggtt

SEQ ID NO: 4359 - RNA, 19 nt, Artificial Sequence
  source: /note="Description of Artificial Sequence: Synthetic oligonucleotide"
ccgccgcucauggcgccga

SEQ ID NO: 4360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgcucauggcgccgatt

SEQ ID NO: 4361 - RNA, 19 nt, Artificial Sequence
  source: /note="Description of Artificial Sequence: Synthetic oligonucleotide"
gucagucggggcuaugggu

SEQ ID NO: 4362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucagucggggcuaugggutt

SEQ ID NO: 4363 - RNA, 19 nt, Artificial Sequence
  source: /note="Description of Artificial Sequence: Synthetic oligonucleotide"
acccauagccccgacugac

SEQ ID NO: 4364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccauagccccgacugactt

SEQ ID NO: 4365 - RNA, 19 nt, Artificial Sequence
  source: /note="Description of Artificial Sequence: Synthetic oligonucleotide"
agucggggcuauggguggg

SEQ ID NO: 4366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucggggcuaugggugggtt

SEQ ID NO: 4367 - RNA, 19 nt, Artificial Sequence
  source: /note="Description of Artificial Sequence: Synthetic oligonucleotide"
cccacccauagccccgacu

SEQ ID NO: 4368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacccauagccccgacutt

SEQ ID NO: 4369 - RNA, 19 nt, Artificial Sequence
  source: /note="Description of Artificial Sequence: Synthetic oligonucleotide"
cgccgggagugaagcuggg

SEQ ID NO: 4370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgggagugaagcugggtt

SEQ ID NO: 4371 - RNA, 19 nt, Artificial Sequence
  source: /note="Description of Artificial Sequence: Synthetic oligonucleotide"
cccagcuucacucccggcg

SEQ ID NO: 4372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcuucacucccggcgtt

SEQ ID NO: 4373 - RNA, 19 nt, Artificial Sequence
  source: /note="Description of Artificial Sequence: Synthetic oligonucleotide"
ccgggagugaagcugggcc

SEQ ID NO: 4374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgggagugaagcugggcctt

SEQ ID NO: 4375 - RNA, 19 nt, Artificial Sequence
  source: /note="Description of Artificial Sequence: Synthetic oligonucleotide"
ggcccagcuucacucccgg

SEQ ID NO: 4376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccagcuucacucccggtt

SEQ ID NO: 4377 - RNA, 19 nt, Artificial Sequence
  source: /note="Description of Artificial Sequence: Synthetic oligonucleotide"
gacagcgggaaggugacca

SEQ ID NO: 4378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacagcgggaaggugaccatt

SEQ ID NO: 4379 - RNA, 19 nt, Artificial Sequence
  source: /note="Description of Artificial Sequence: Synthetic oligonucleotide"
uggucaccuucccgcuguc

SEQ ID NO: 4380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggucaccuucccgcuguctt

SEQ ID NO: 4381 - RNA, 19 nt, Artificial Sequence
  source: /note="Description of Artificial Sequence: Synthetic oligonucleotide"
cagcgggaaggugaccaca

SEQ ID NO: 4382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcgggaaggugaccacatt

SEQ ID NO: 4383 - RNA, 19 nt, Artificial Sequence
  source: /note="Description of Artificial Sequence: Synthetic oligonucleotide"
uguggucaccuucccgcug

SEQ ID NO: 4384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggucaccuucccgcugtt

SEQ ID NO: 4385 - RNA, 19 nt, Artificial Sequence
  source: /note="Description of Artificial Sequence: Synthetic oligonucleotide"
aaggcccagagcguuccca

SEQ ID NO: 4386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcccagagcguucccatt

SEQ ID NO: 4387 - RNA, 19 nt, Artificial Sequence
  source: /note="Description of Artificial Sequence: Synthetic oligonucleotide"
ugggaacgcucugggccuu

SEQ ID NO: 4388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggaacgcucugggccuutt

SEQ ID NO: 4389 - RNA, 19 nt, Artificial Sequence
  source: /note="Description of Artificial Sequence: Synthetic oligonucleotide"
aggcccagagcguucccaa

SEQ ID NO: 4390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcccagagcguucccaatt

SEQ ID NO: 4391 - RNA, 19 nt, Artificial Sequence
  source: /note="Description of Artificial Sequence: Synthetic oligonucleotide"
uugggaacgcucugggccu

SEQ ID NO: 4392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggaacgcucugggccutt

SEQ ID NO: 4393 - RNA, 19 nt, Artificial Sequence
  source: /note="Description of Artificial Sequence: Synthetic oligonucleotide"
ggcccagagcguucccaag

SEQ ID NO: 4394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccagagcguucccaagtt

SEQ ID NO: 4395 - RNA, 19 nt, Artificial Sequence
  source: /note="Description of Artificial Sequence: Synthetic oligonucleotide"
cuugggaacgcucugggcc

SEQ ID NO: 4396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugggaacgcucugggcctt

SEQ ID NO: 4397 - RNA, 19 nt, Artificial Sequence
  source: /note="Description of Artificial Sequence: Synthetic oligonucleotide"
cuuacacugacaucaaagu

SEQ ID NO: 4398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuacacugacaucaaagutt

SEQ ID NO: 4399 - RNA, 19 nt, Artificial Sequence
  source: /note="Description of Artificial Sequence: Synthetic oligonucleotide"
acuuugaugucaguguaag

SEQ ID NO: 4400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuugaugucaguguaagtt

SEQ ID NO: 4401 - RNA, 19 nt, Artificial Sequence
  source: /note="Description of Artificial Sequence: Synthetic oligonucleotide"
uuacacugacaucaaagug

SEQ ID NO: 4402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacacugacaucaaagugtt

SEQ ID NO: 4403 - RNA, 19 nt, Artificial Sequence
  source: /note="Description of Artificial Sequence: Synthetic oligonucleotide"
cacuuugaugucaguguaa

SEQ ID NO: 4404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuuugaugucaguguaatt

SEQ ID NO: 4405 - RNA, 19 nt, Artificial Sequence
  source: /note="Description of Artificial Sequence: Synthetic oligonucleotide"
cuggcagagacgagggaac

SEQ ID NO: 4406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcagagacgagggaactt

SEQ ID NO: 4407 - RNA, 19 nt, Artificial Sequence
  source: /note="Description of Artificial Sequence: Synthetic oligonucleotide"
guucccucgucucugccag

SEQ ID NO: 4408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucccucgucucugccagtt

SEQ ID NO: 4409 - RNA, 19 nt, Artificial Sequence
  source: /note="Description of Artificial Sequence: Synthetic oligonucleotide"
uggcagagacgagggaacu

SEQ ID NO: 4410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcagagacgagggaacutt

SEQ ID NO: 4411 - RNA, 19 nt, Artificial Sequence
  source: /note="Description of Artificial Sequence: Synthetic oligonucleotide"
aguucccucgucucugcca

SEQ ID NO: 4412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucccucgucucugccatt

SEQ ID NO: 4413 - RNA, 19 nt, Artificial Sequence
  source: /note="Description of Artificial Sequence: Synthetic oligonucleotide"
gagaagaaggacgagcugu

SEQ ID NO: 4414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaagaaggacgagcugutt

SEQ ID NO: 4415 - RNA, 19 nt, Artificial Sequence
  source: /note="Description of Artificial Sequence: Synthetic oligonucleotide"
acagcucguccuucuucuc

SEQ ID NO: 4416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcucguccuucuucuctt

SEQ ID NO: 4417 - RNA, 19 nt, Artificial Sequence
  source: /note="Description of Artificial Sequence: Synthetic oligonucleotide"
cgagcuguauuugaaucug

SEQ ID NO: 4418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcuguauuugaaucugtt

SEQ ID NO: 4419 - RNA, 19 nt, Artificial Sequence
  source: /note="Description of Artificial Sequence: Synthetic oligonucleotide"
cagauucaaauacagcucg

SEQ ID NO: 4420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauucaaauacagcucgtt

SEQ ID NO: 4421 - RNA, 19 nt, Artificial Sequence
  source: /note="Description of Artificial Sequence: Synthetic oligonucleotide"
gagcuguauuugaaucugg

SEQ ID NO: 4422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuguauuugaaucuggtt

SEQ ID NO: 4423 - RNA, 19 nt, Artificial Sequence
  source: /note="Description of Artificial Sequence: Synthetic oligonucleotide"
ccagauucaaauacagcuc

SEQ ID NO: 4424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagauucaaauacagcuctt

SEQ ID NO: 4425 - RNA, 19 nt, Artificial Sequence
  source: /note="Description of Artificial Sequence: Synthetic oligonucleotide"
cugaucaccccuaucaucu

SEQ ID NO: 4426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaucaccccuaucaucutt

SEQ ID NO: 4427 - RNA, 19 nt, Artificial Sequence
  source: /note="Description of Artificial Sequence: Synthetic oligonucleotide"
agaugauaggggugaucag

SEQ ID NO: 4428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugauaggggugaucagtt

SEQ ID NO: 4429 - RNA, 19 nt, Artificial Sequence
  source: /note="Description of Artificial Sequence: Synthetic oligonucleotide"
ugaucaccccuaucaucua

SEQ ID NO: 4430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucaccccuaucaucuatt

SEQ ID NO: 4431 - RNA, 19 nt, Artificial Sequence
  source: /note="Description of Artificial Sequence: Synthetic oligonucleotide"
uagaugauaggggugauca

SEQ ID NO: 4432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaugauaggggugaucatt

SEQ ID NO: 4433 - RNA, 19 nt, Artificial Sequence
  source: /note="Description of Artificial Sequence: Synthetic oligonucleotide"
gaucaccccuaucaucuac

SEQ ID NO: 4434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaccccuaucaucuactt

SEQ ID NO: 4435 - RNA, 19 nt, Artificial Sequence
  source: /note="Description of Artificial Sequence: Synthetic oligonucleotide"
guagaugauaggggugauc

SEQ ID NO: 4436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaugauaggggugauctt

SEQ ID NO: 4437 - RNA, 19 nt, Artificial Sequence
  source: /note="Description of Artificial Sequence: Synthetic oligonucleotide"
gucaccgugacaucaagcc

SEQ ID NO: 4438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaccgugacaucaagcctt

SEQ ID NO: 4439 - RNA, 19 nt, Artificial Sequence
  source: /note="Description of Artificial Sequence: Synthetic oligonucleotide"
ggcuugaugucacggugac

SEQ ID NO: 4440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuugaugucacggugactt

SEQ ID NO: 4441 - RNA, 19 nt, Artificial Sequence
  source: /note="Description of Artificial Sequence: Synthetic oligonucleotide"
cgugacaucaagccccaga

SEQ ID NO: 4442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugacaucaagccccagatt

SEQ ID NO: 4443 - RNA, 19 nt, Artificial Sequence
  source: /note="Description of Artificial Sequence: Synthetic oligonucleotide"
ucuggggcuugaugucacg

SEQ ID NO: 4444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggggcuugaugucacgtt

SEQ ID NO: 4445 - RNA, 19 nt, Artificial Sequence
  source: /note="Description of Artificial Sequence: Synthetic oligonucleotide"
ugacaucaagccccagaau

SEQ ID NO: 4446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacaucaagccccagaautt

SEQ ID NO: 4447 - RNA, 19 nt, Artificial Sequence
  source: /note="Description of Artificial Sequence: Synthetic oligonucleotide"
auucuggggcuugauguca

SEQ ID NO: 4448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucuggggcuugaugucatt

SEQ ID NO: 4449 - RNA, 19 nt, Artificial Sequence
  source: /note="Description of Artificial Sequence: Synthetic oligonucleotide"
auguguccuacaucugcuc

SEQ ID NO: 4450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguguccuacaucugcuctt

SEQ ID NO: 4451 - RNA, 19 nt, Artificial Sequence
  source: /note="Description of Artificial Sequence: Synthetic oligonucleotide"
gagcagauguaggacacau

SEQ ID NO: 4452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcagauguaggacacautt

SEQ ID NO: 4453 - RNA, 19 nt, Artificial Sequence
  source: /note="Description of Artificial Sequence: Synthetic oligonucleotide"
uguguccuacaucugcucu

SEQ ID NO: 4454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguccuacaucugcucutt

SEQ ID NO: 4455 - RNA, 19 nt, Artificial Sequence
  source: /note="Description of Artificial Sequence: Synthetic oligonucleotide"
agagcagauguaggacaca

SEQ ID NO: 4456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcagauguaggacacatt

SEQ ID NO: 4457 - RNA, 19 nt, Artificial Sequence
  source: /note="Description of Artificial Sequence: Synthetic oligonucleotide"
uguguggucggcuggcugu

SEQ ID NO: 4458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguggucggcuggcugutt

SEQ ID NO: 4459 - RNA, 19 nt, Artificial Sequence
  source: /note="Description of Artificial Sequence: Synthetic oligonucleotide"
acagccagccgaccacaca

SEQ ID NO: 4460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagccagccgaccacacatt

SEQ ID NO: 4461 - RNA, 19 nt, Artificial Sequence
  source: /note="Description of Artificial Sequence: Synthetic oligonucleotide"
ggucggcuggcuguguacu

SEQ ID NO: 4462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucggcuggcuguguacutt

SEQ ID NO: 4463 - RNA, 19 nt, Artificial Sequence
  source: /note="Description of Artificial Sequence: Synthetic oligonucleotide"
aguacacagccagccgacc

SEQ ID NO: 4464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguacacagccagccgacctt

SEQ ID NO: 4465 - RNA, 19 nt, Artificial Sequence
  source: /note="Description of Artificial Sequence: Synthetic oligonucleotide"
ggggacagugggguggacc

SEQ ID NO: 4466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggacagugggguggacctt

SEQ ID NO: 4467 - RNA, 19 nt, Artificial Sequence
  source: /note="Description of Artificial Sequence: Synthetic oligonucleotide"
gguccaccccacugucccc

SEQ ID NO: 4468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccaccccacugucccctt

SEQ ID NO: 4469 - RNA, 19 nt, Artificial Sequence
  source: /note="Description of Artificial Sequence: Synthetic oligonucleotide"
acggaguucaaguuccccc

SEQ ID NO: 4470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggaguucaaguuccccctt

SEQ ID NO: 4471 - RNA, 19 nt, Artificial Sequence
  source: /note="Description of Artificial Sequence: Synthetic oligonucleotide"
gggggaacuugaacuccgu

SEQ ID NO: 4472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggaacuugaacuccgutt

SEQ ID NO: 4473 - RNA, 19 nt, Artificial Sequence
  source: /note="Description of Artificial Sequence: Synthetic oligonucleotide"
ucacccuuggacaaaggug

SEQ ID NO: 4474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacccuuggacaaaggugtt

SEQ ID NO: 4475 - RNA, 19 nt, Artificial Sequence
  source: /note="Description of Artificial Sequence: Synthetic oligonucleotide"
caccuuuguccaaggguga

SEQ ID NO: 4476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuuuguccaagggugatt

SEQ ID NO: 4477 - RNA, 19 nt, Artificial Sequence
  source: /note="Description of Artificial Sequence: Synthetic oligonucleotide"
acccuuggacaaagguguu

SEQ ID NO: 4478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccuuggacaaagguguutt

SEQ ID NO: 4479 - RNA, 19 nt, Artificial Sequence
  source: /note="Description of Artificial Sequence: Synthetic oligonucleotide"
aacaccuuuguccaagggu

SEQ ID NO: 4480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaccuuuguccaagggutt

SEQ ID NO: 4481 - RNA, 19 nt, Artificial Sequence
  source: /note="Description of Artificial Sequence: Synthetic oligonucleotide"
ugaggccauugcacucugc

SEQ ID NO: 4482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggccauugcacucugctt

SEQ ID NO: 4483 - RNA, 19 nt, Artificial Sequence
  source: /note="Description of Artificial Sequence: Synthetic oligonucleotide"
gcagagugcaauggccuca

SEQ ID NO: 4484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagugcaauggccucatt

SEQ ID NO: 4485 - RNA, 19 nt, Artificial Sequence
  source: /note="Description of Artificial Sequence: Synthetic oligonucleotide"
aggccauugcacucugcuc

SEQ ID NO: 4486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccauugcacucugcuctt

SEQ ID NO: 4487 - RNA, 19 nt, Artificial Sequence
  source: /note="Description of Artificial Sequence: Synthetic oligonucleotide"
gagcagagugcaauggccu

SEQ ID NO: 4488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcagagugcaauggccutt

SEQ ID NO: 4489 - RNA, 19 nt, Artificial Sequence
  source: /note="Description of Artificial Sequence: Synthetic oligonucleotide"
ccauugcacucugcucuag

SEQ ID NO: 4490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauugcacucugcucuagtt

SEQ ID NO: 4491 - RNA, 19 nt, Artificial Sequence
  source: /note="Description of Artificial Sequence: Synthetic oligonucleotide"
cuagagcagagugcaaugg

SEQ ID NO: 4492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagagcagagugcaauggtt

SEQ ID NO: 4493 - RNA, 19 nt, Artificial Sequence
  source: /note="Description of Artificial Sequence: Synthetic oligonucleotide"
ugcacucugcucuagccua

SEQ ID NO: 4494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacucugcucuagccuatt

SEQ ID NO: 4495 - RNA, 19 nt, Artificial Sequence
  source: /note="Description of Artificial Sequence: Synthetic oligonucleotide"
uaggcuagagcagagugca

SEQ ID NO: 4496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggcuagagcagagugcatt

SEQ ID NO: 4497 - RNA, 19 nt, Artificial Sequence
  source: /note="Description of Artificial Sequence: Synthetic oligonucleotide"
uagccuacuggaguacacg

SEQ ID NO: 4498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccuacuggaguacacgtt

SEQ ID NO: 4499 - RNA, 19 nt, Artificial Sequence
  source: /note="Description of Artificial Sequence: Synthetic oligonucleotide"
cguguacuccaguaggcua

SEQ ID NO: 4500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguguacuccaguaggcuatt

SEQ ID NO: 4501 - RNA, 19 nt, Artificial Sequence
  source: /note="Description of Artificial Sequence: Synthetic oligonucleotide"
cacucgaggcuugugccca

SEQ ID NO: 4502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucgaggcuugugcccatt

SEQ ID NO: 4503 - RNA, 19 nt, Artificial Sequence
  source: /note="Description of Artificial Sequence: Synthetic oligonucleotide"
ugggcacaagccucgagug

SEQ ID NO: 4504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcacaagccucgagugtt

SEQ ID NO: 4505 - RNA, 19 nt, Artificial Sequence
  source: /note="Description of Artificial Sequence: Synthetic oligonucleotide"
cgcccgcuucccccccugu

SEQ ID NO: 4506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcccgcuucccccccugutt

SEQ ID NO: 4507 - RNA, 19 nt, Artificial Sequence
  source: /note="Description of Artificial Sequence: Synthetic oligonucleotide"
acagggggggaagcgggcg

SEQ ID NO: 4508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagggggggaagcgggcgtt

SEQ ID NO: 4509 - RNA, 19 nt, Artificial Sequence
  source: /note="Description of Artificial Sequence: Synthetic oligonucleotide"
cuucaguccuggugaacug

SEQ ID NO: 4510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaguccuggugaacugtt

SEQ ID NO: 4511 - RNA, 19 nt, Artificial Sequence
  source: /note="Description of Artificial Sequence: Synthetic oligonucleotide"
caguucaccaggacugaag

SEQ ID NO: 4512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguucaccaggacugaagtt

SEQ ID NO: 4513 - RNA, 19 nt, Artificial Sequence
  source: /note="Description of Artificial Sequence: Synthetic oligonucleotide"
ucacaagcuuuaacugaag

SEQ ID NO: 4514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacaagcuuuaacugaagtt

SEQ ID NO: 4515 - RNA, 19 nt, Artificial Sequence
  source: /note="Description of Artificial Sequence: Synthetic oligonucleotide"
cuucaguuaaagcuuguga

SEQ ID NO: 4516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaguuaaagcuugugatt

SEQ ID NO: 4517 - RNA, 19 nt, Artificial Sequence
  source: /note="Description of Artificial Sequence: Synthetic oligonucleotide"
cagacuggccaagauuggc

SEQ ID NO: 4518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagacuggccaagauuggctt

SEQ ID NO: 4519 - RNA, 19 nt, Artificial Sequence
  source: /note="Description of Artificial Sequence: Synthetic oligonucleotide"
gccaaucuuggccagucug

SEQ ID NO: 4520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaaucuuggccagucugtt

SEQ ID NO: 4521 - RNA, 19 nt, Artificial Sequence
  source: /note="Description of Artificial Sequence: Synthetic oligonucleotide"
agacuggccaagauuggca

SEQ ID NO: 4522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacuggccaagauuggcatt

SEQ ID NO: 4523 - RNA, 19 nt, Artificial Sequence
  source: /note="Description of Artificial Sequence: Synthetic oligonucleotide"
ugccaaucuuggccagucu

SEQ ID NO: 4524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaaucuuggccagucutt

SEQ ID NO: 4525 - RNA, 19 nt, Artificial Sequence
  source: /note="Description of Artificial Sequence: Synthetic oligonucleotide"
acccucgcuagcucuuccu

SEQ ID NO: 4526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccucgcuagcucuuccutt

SEQ ID NO: 4527 - RNA, 19 nt, Artificial Sequence
  source: /note="Description of Artificial Sequence: Synthetic oligonucleotide"
aggaagagcuagcgagggu

SEQ ID NO: 4528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaagagcuagcgagggutt

SEQ ID NO: 4529 - RNA, 19 nt, Artificial Sequence
  source: /note="Description of Artificial Sequence: Synthetic oligonucleotide"
ggccccaccgacuaccccu

SEQ ID NO: 4530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccaccgacuaccccutt

SEQ ID NO: 4531 - RNA, 19 nt, Artificial Sequence
  source: /note="Description of Artificial Sequence: Synthetic oligonucleotide"
agggguagucgguggggcc

SEQ ID NO: 4532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggguagucgguggggcctt

SEQ ID NO: 4533 - RNA, 19 nt, Artificial Sequence
  source: /note="Description of Artificial Sequence: Synthetic oligonucleotide"
ccuaaccucuguggugggc

SEQ ID NO: 4534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaaccucuguggugggctt

SEQ ID NO: 4535 - RNA, 19 nt, Artificial Sequence
  source: /note="Description of Artificial Sequence: Synthetic oligonucleotide"
gcccaccacagagguuagg

SEQ ID NO: 4536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaccacagagguuaggtt

SEQ ID NO: 4537 - RNA, 19 nt, Artificial Sequence
  source: /note="Description of Artificial Sequence: Synthetic oligonucleotide"
cuaaccucuguggugggcu

SEQ ID NO: 4538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaaccucuguggugggcutt

SEQ ID NO: 4539 - RNA, 19 nt, Artificial Sequence
  source: /note="Description of Artificial Sequence: Synthetic oligonucleotide"
agcccaccacagagguuag

SEQ ID NO: 4540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaccacagagguuagtt

SEQ ID NO: 4541 - RNA, 19 nt, Artificial Sequence
  source: /note="Description of Artificial Sequence: Synthetic oligonucleotide"
uaacuguuuguaggggagg

SEQ ID NO: 4542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacuguuuguaggggaggtt

SEQ ID NO: 4543 - RNA, 19 nt, Artificial Sequence
  source: /note="Description of Artificial Sequence: Synthetic oligonucleotide"
ccuccccuacaaacaguua

SEQ ID NO: 4544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccccuacaaacaguuatt

SEQ ID NO: 4545 - RNA, 19 nt, Artificial Sequence
  source: /note="Description of Artificial Sequence: Synthetic oligonucleotide"
uuuguaggggaggggagaa

SEQ ID NO: 4546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuguaggggaggggagaatt

SEQ ID NO: 4547 - RNA, 19 nt, Artificial Sequence
  source: /note="Description of Artificial Sequence: Synthetic oligonucleotide"
uucuccccuccccuacaaa

SEQ ID NO: 4548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuccccuccccuacaaatt

SEQ ID NO: 4549 - RNA, 19 nt, Artificial Sequence
  source: /note="Description of Artificial Sequence: Synthetic oligonucleotide"
uucuacccccuuggucccc

SEQ ID NO: 4550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuacccccuuggucccctt

SEQ ID NO: 4551 - RNA, 19 nt, Artificial Sequence
  source: /note="Description of Artificial Sequence: Synthetic oligonucleotide"
ggggaccaaggggguagaa

SEQ ID NO: 4552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaccaaggggguagaatt

SEQ ID NO: 4553 - RNA, 19 nt, Artificial Sequence
  source: /note="Description of Artificial Sequence: Synthetic oligonucleotide"
ucccccccucucccagguc

SEQ ID NO: 4554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccccccucucccagguctt

SEQ ID NO: 4555 - RNA, 19 nt, Artificial Sequence
  source: /note="Description of Artificial Sequence: Synthetic oligonucleotide"
gaccugggagaggggggga

SEQ ID NO: 4556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccugggagagggggggatt

SEQ ID NO: 4557 - RNA, 19 nt, Artificial Sequence
  source: /note="Description of Artificial Sequence: Synthetic oligonucleotide"
cucgucuucccuucccugg

SEQ ID NO: 4558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgucuucccuucccuggtt

SEQ ID NO: 4559 - RNA, 19 nt, Artificial Sequence
  source: /note="Description of Artificial Sequence: Synthetic oligonucleotide"
ccagggaagggaagacgag

SEQ ID NO: 4560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggaagggaagacgagtt

SEQ ID NO: 4561 - RNA, 19 nt, Artificial Sequence
  source: /note="Description of Artificial Sequence: Synthetic oligonucleotide"
ucgucuucccuucccuggc

SEQ ID NO: 4562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgucuucccuucccuggctt

SEQ ID NO: 4563 - RNA, 19 nt, Artificial Sequence
  source: /note="Description of Artificial Sequence: Synthetic oligonucleotide"
gccagggaagggaagacga

SEQ ID NO: 4564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagggaagggaagacgatt

SEQ ID NO: 4565 - RNA, 19 nt, Artificial Sequence
  source: /note="Description of Artificial Sequence: Synthetic oligonucleotide"
cgucuucccuucccuggcc

SEQ ID NO: 4566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucuucccuucccuggcctt

SEQ ID NO: 4567 - RNA, 19 nt, Artificial Sequence
  source: /note="Description of Artificial Sequence: Synthetic oligonucleotide"
ggccagggaagggaagacg

SEQ ID NO: 4568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccagggaagggaagacgtt

SEQ ID NO: 4569 - RNA, 19 nt, Artificial Sequence
  source: /note="Description of Artificial Sequence: Synthetic oligonucleotide"
agaccucuguucaauaaau

SEQ ID NO: 4570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaccucuguucaauaaautt

SEQ ID NO: 4571 - RNA, 19 nt, Artificial Sequence
  source: /note="Description of Artificial Sequence: Synthetic oligonucleotide"
auuuauugaacagaggucu

SEQ ID NO: 4572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuauugaacagaggucutt

SEQ ID NO: 4573 - RNA, 19 nt, Artificial Sequence
  source: /note="Description of Artificial Sequence: Synthetic oligonucleotide"
ccucuguucaauaaauuau

SEQ ID NO: 4574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuguucaauaaauuautt

SEQ ID NO: 4575 - RNA, 19 nt, Artificial Sequence
  source: /note="Description of Artificial Sequence: Synthetic oligonucleotide"
auaauuuauugaacagagg

SEQ ID NO: 4576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaauuuauugaacagaggtt

SEQ ID NO: 4577 - RNA, 19 nt, Artificial Sequence
  source: /note="Description of Artificial Sequence: Synthetic oligonucleotide"
ucuguucaauaaauuauug

SEQ ID NO: 4578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguucaauaaauuauugtt

SEQ ID NO: 4579 - RNA, 19 nt, Artificial Sequence
  source: /note="Description of Artificial Sequence: Synthetic oligonucleotide"
caauaauuuauugaacaga

SEQ ID NO: 4580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauaauuuauugaacagatt

SEQ ID NO: 4581 - RNA, 19 nt, Artificial Sequence
  source: /note="Description of Artificial Sequence: Synthetic oligonucleotide"
aacgaagccgacggcagag

SEQ ID NO: 4582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgaagccgacggcagagtt

SEQ ID NO: 4583 - RNA, 19 nt, Artificial Sequence
  source: /note="Description of Artificial Sequence: Synthetic oligonucleotide"
cucugccgucggcuucguu

SEQ ID NO: 4584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugccgucggcuucguutt

SEQ ID NO: 4585 - RNA, 19 nt, Artificial Sequence
  source: /note="Description of Artificial Sequence: Synthetic oligonucleotide"
acgaagccgacggcagagg

SEQ ID NO: 4586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgaagccgacggcagaggtt

SEQ ID NO: 4587 - RNA, 19 nt, Artificial Sequence
  source: /note="Description of Artificial Sequence: Synthetic oligonucleotide"
ccucugccgucggcuucgu

SEQ ID NO: 4588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucugccgucggcuucgutt

SEQ ID NO: 4589 - RNA, 19 nt, Artificial Sequence
  source: /note="Description of Artificial Sequence: Synthetic oligonucleotide"
cggcagagggacuucaucu

SEQ ID NO: 4590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcagagggacuucaucutt

SEQ ID NO: 4591 - RNA, 19 nt, Artificial Sequence
  source: /note="Description of Artificial Sequence: Synthetic oligonucleotide"
agaugaagucccucugccg

SEQ ID NO: 4592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugaagucccucugccgtt

SEQ ID NO: 4593 - RNA, 19 nt, Artificial Sequence
  source: /note="Description of Artificial Sequence: Synthetic oligonucleotide"
agggacuucaucucccggc

SEQ ID NO: 4594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggacuucaucucccggctt

SEQ ID NO: 4595 - RNA, 19 nt, Artificial Sequence
  source: /note="Description of Artificial Sequence: Synthetic oligonucleotide"
gccgggagaugaagucccu

SEQ ID NO: 4596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgggagaugaagucccutt

SEQ ID NO: 4597 - RNA, 19 nt, Artificial Sequence
  source: /note="Description of Artificial Sequence: Synthetic oligonucleotide"
gggacuucaucucccggcg

SEQ ID NO: 4598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggacuucaucucccggcgtt

SEQ ID NO: 4599 - RNA, 19 nt, Artificial Sequence
  source: /note="Description of Artificial Sequence: Synthetic oligonucleotide"
cgccgggagaugaaguccc

SEQ ID NO: 4600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgggagaugaaguccctt

SEQ ID NO: 4601 - RNA, 19 nt, Artificial Sequence
  source: /note="Description of Artificial Sequence: Synthetic oligonucleotide"
ggacuucaucucccggcgu

SEQ ID NO: 4602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacuucaucucccggcgutt

SEQ ID NO: 4603 - RNA, 19 nt, Artificial Sequence
  source: /note="Description of Artificial Sequence: Synthetic oligonucleotide"
acgccgggagaugaagucc

SEQ ID NO: 4604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgccgggagaugaagucctt

SEQ ID NO: 4605 - RNA, 19 nt, Artificial Sequence
  source: /note="Description of Artificial Sequence: Synthetic oligonucleotide"
gacuucaucucccggcgug

SEQ ID NO: 4606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuucaucucccggcgugtt

SEQ ID NO: 4607 - RNA, 19 nt, Artificial Sequence
  source: /note="Description of Artificial Sequence: Synthetic oligonucleotide"
cacgccgggagaugaaguc

SEQ ID NO: 4608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacgccgggagaugaaguctt

SEQ ID NO: 4609 - RNA, 19 nt, Artificial Sequence
  source: /note="Description of Artificial Sequence: Synthetic oligonucleotide"
cucccggcgugccccgcgg

SEQ ID NO: 4610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccggcgugccccgcggtt

SEQ ID NO: 4611 - RNA, 19 nt, Artificial Sequence
  source: /note="Description of Artificial Sequence: Synthetic oligonucleotide"
ccgcggggcacgccgggag

SEQ ID NO: 4612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcggggcacgccgggagtt

SEQ ID NO: 4613 - RNA, 19 nt, Artificial Sequence
  source: /note="Description of Artificial Sequence: Synthetic oligonucleotide"
ucccggcgugccccgcggc

SEQ ID NO: 4614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccggcgugccccgcggctt

SEQ ID NO: 4615 - RNA, 19 nt, Artificial Sequence
  source: /note="Description of Artificial Sequence: Synthetic oligonucleotide"
gccgcggggcacgccggga

SEQ ID NO: 4616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcggggcacgccgggatt

SEQ ID NO: 4617 - RNA, 19 nt, Artificial Sequence
  source: /note="Description of Artificial Sequence: Synthetic oligonucleotide"
ggcgugccccgcggcgggc

SEQ ID NO: 4618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgugccccgcggcgggctt

SEQ ID NO: 4619 - RNA, 19 nt, Artificial Sequence
  source: /note="Description of Artificial Sequence: Synthetic oligonucleotide"
gcccgccgcggggcacgcc

SEQ ID NO: 4620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgccgcggggcacgcctt

SEQ ID NO: 4621 - RNA, 19 nt, Artificial Sequence
  source: /note="Description of Artificial Sequence: Synthetic oligonucleotide"
gcgugccccgcggcgggcg

SEQ ID NO: 4622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgugccccgcggcgggcgtt

SEQ ID NO: 4623 - RNA, 19 nt, Artificial Sequence
  source: /note="Description of Artificial Sequence: Synthetic oligonucleotide"
cgcccgccgcggggcacgc

SEQ ID NO: 4624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcccgccgcggggcacgctt

SEQ ID NO: 4625 - RNA, 19 nt, Artificial Sequence
  source: /note="Description of Artificial Sequence: Synthetic oligonucleotide"
gcgcugggccggagccgga

SEQ ID NO: 4626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcugggccggagccggatt

SEQ ID NO: 4627 - RNA, 19 nt, Artificial Sequence
  source: /note="Description of Artificial Sequence: Synthetic oligonucleotide"
uccggcuccggcccagcgc

SEQ ID NO: 4628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggcuccggcccagcgctt

SEQ ID NO: 4629 - RNA, 19 nt, Artificial Sequence
  source: /note="Description of Artificial Sequence: Synthetic oligonucleotide"
cgcugggccggagccggag

SEQ ID NO: 4630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugggccggagccggagtt

SEQ ID NO: 4631 - RNA, 19 nt, Artificial Sequence
  source: /note="Description of Artificial Sequence: Synthetic oligonucleotide"
cuccggcuccggcccagcg

SEQ ID NO: 4632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggcuccggcccagcgtt

SEQ ID NO: 4633 - RNA, 19 nt, Artificial Sequence
  source: /note="Description of Artificial Sequence: Synthetic oligonucleotide"
agaggccggagcccagggg

SEQ ID NO: 4634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggccggagcccaggggtt

SEQ ID NO: 4635 - RNA, 19 nt, Artificial Sequence
  source: /note="Description of Artificial Sequence: Synthetic oligonucleotide"
ccccugggcuccggccucu

SEQ ID NO: 4636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccugggcuccggccucutt

SEQ ID NO: 4637 - RNA, 19 nt, Artificial Sequence
  source: /note="Description of Artificial Sequence: Synthetic oligonucleotide"
agcccaggggaggcggcgg

SEQ ID NO: 4638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaggggaggcggcggtt

SEQ ID NO: 4639 - RNA, 19 nt, Artificial Sequence
  source: /note="Description of Artificial Sequence: Synthetic oligonucleotide"
ccgccgccuccccugggcu

SEQ ID NO: 4640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgccuccccugggcutt

SEQ ID NO: 4641 - RNA, 19 nt, Artificial Sequence
  source: /note="Description of Artificial Sequence: Synthetic oligonucleotide"
gcccaggggaggcggcggc

SEQ ID NO: 4642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaggggaggcggcggctt

SEQ ID NO: 4643 - RNA, 19 nt, Artificial Sequence
  source: /note="Description of Artificial Sequence: Synthetic oligonucleotide"
gccgccgccuccccugggc

SEQ ID NO: 4644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccgccuccccugggctt

SEQ ID NO: 4645 - RNA, 19 nt, Artificial Sequence
  source: /note="Description of Artificial Sequence: Synthetic oligonucleotide"
cagcggcgggggcagccca

SEQ ID NO: 4646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcggcgggggcagcccatt

SEQ ID NO: 4647 - RNA, 19 nt, Artificial Sequence
  source: /note="Description of Artificial Sequence: Synthetic oligonucleotide"
ugggcugcccccgccgcug

SEQ ID NO: 4648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcugcccccgccgcugtt

SEQ ID NO: 4649 - RNA, 19 nt, Artificial Sequence
  source: /note="Description of Artificial Sequence: Synthetic oligonucleotide"
gcggcgggggcagcccagg

SEQ ID NO: 4650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcgggggcagcccaggtt

SEQ ID NO: 4651 - RNA, 19 nt, Artificial Sequence
  source: /note="Description of Artificial Sequence: Synthetic oligonucleotide"
ccugggcugcccccgccgc

SEQ ID NO: 4652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggcugcccccgccgctt

SEQ ID NO: 4653 - RNA, 19 nt, Artificial Sequence
  source: /note="Description of Artificial Sequence: Synthetic oligonucleotide"
cggcgggggcagcccaggc

SEQ ID NO: 4654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgggggcagcccaggctt

SEQ ID NO: 4655 - RNA, 19 nt, Artificial Sequence
  source: /note="Description of Artificial Sequence: Synthetic oligonucleotide"
gccugggcugcccccgccg

SEQ ID NO: 4656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugggcugcccccgccgtt

SEQ ID NO: 4657 - RNA, 19 nt, Artificial Sequence
  source: /note="Description of Artificial Sequence: Synthetic oligonucleotide"
gggggcagcccaggcagcc

SEQ ID NO: 4658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggcagcccaggcagcctt

SEQ ID NO: 4659 - RNA, 19 nt, Artificial Sequence
  source: /note="Description of Artificial Sequence: Synthetic oligonucleotide"
ggcugccugggcugccccc

SEQ ID NO: 4660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugccugggcugccccctt

SEQ ID NO: 4661 - RNA, 19 nt, Artificial Sequence
  source: /note="Description of Artificial Sequence: Synthetic oligonucleotide"
ccgcggccugggccugcgc

SEQ ID NO: 4662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcggccugggccugcgctt

SEQ ID NO: 4663 - RNA, 19 nt, Artificial Sequence
  source: /note="Description of Artificial Sequence: Synthetic oligonucleotide"
gcgcaggcccaggccgcgg

SEQ ID NO: 4664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcaggcccaggccgcggtt

SEQ ID NO: 4665 - RNA, 19 nt, Artificial Sequence
  source: /note="Description of Artificial Sequence: Synthetic oligonucleotide"
gccugggccugcgcucggc

SEQ ID NO: 4666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugggccugcgcucggctt

SEQ ID NO: 4667 - RNA, 19 nt, Artificial Sequence
  source: /note="Description of Artificial Sequence: Synthetic oligonucleotide"
gccgagcgcaggcccaggc

SEQ ID NO: 4668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgagcgcaggcccaggctt

SEQ ID NO: 4669 - RNA, 19 nt, Artificial Sequence
  source: /note="Description of Artificial Sequence: Synthetic oligonucleotide"
ccugggccugcgcucggcg

SEQ ID NO: 4670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggccugcgcucggcgtt

SEQ ID NO: 4671 - RNA, 19 nt, Artificial Sequence
  source: /note="Description of Artificial Sequence: Synthetic oligonucleotide"
cgccgagcgcaggcccagg

SEQ ID NO: 4672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgagcgcaggcccaggtt

SEQ ID NO: 4673 - RNA, 19 nt, Artificial Sequence
  source: /note="Description of Artificial Sequence: Synthetic oligonucleotide"
cggcgccaugagcggcggc

SEQ ID NO: 4674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgccaugagcggcggctt

SEQ ID NO: 4675 - RNA, 19 nt, Artificial Sequence
  source: /note="Description of Artificial Sequence: Synthetic oligonucleotide"
gccgccgcucauggcgccg

SEQ ID NO: 4676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccgcucauggcgccgtt

SEQ ID NO: 4677 - RNA, 19 nt, Artificial Sequence
  source: /note="Description of Artificial Sequence: Synthetic oligonucleotide"
ggcgggccuucgggaggcg

SEQ ID NO: 4678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggccuucgggaggcgtt

SEQ ID NO: 4679 - RNA, 19 nt, Artificial Sequence
  source: /note="Description of Artificial Sequence: Synthetic oligonucleotide"
cgccucccgaaggcccgcc

SEQ ID NO: 4680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccucccgaaggcccgcctt

SEQ ID NO: 4681 - RNA, 19 nt, Artificial Sequence
  source: /note="Description of Artificial Sequence: Synthetic oligonucleotide"
gaggcggcccugggggcuc

SEQ ID NO: 4682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcggcccugggggcuctt

SEQ ID NO: 4683 - RNA, 19 nt, Artificial Sequence
  source: /note="Description of Artificial Sequence: Synthetic oligonucleotide"
gagcccccagggccgccuc

SEQ ID NO: 4684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccccagggccgccuctt

SEQ ID NO: 4685 - RNA, 19 nt, Artificial Sequence
  source: /note="Description of Artificial Sequence: Synthetic oligonucleotide"
aggcggcccugggggcucg

SEQ ID NO: 4686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcggcccugggggcucgtt

SEQ ID NO: 4687 - RNA, 19 nt, Artificial Sequence
  source: /note="Description of Artificial Sequence: Synthetic oligonucleotide"
cgagcccccagggccgccu

SEQ ID NO: 4688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcccccagggccgccutt

SEQ ID NO: 4689 - RNA, 19 nt, Artificial Sequence
  source: /note="Description of Artificial Sequence: Synthetic oligonucleotide"
ggcggcccugggggcucgg

SEQ ID NO: 4690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcccugggggcucggtt

SEQ ID NO: 4691 - RNA, 19 nt, Artificial Sequence
  source: /note="Description of Artificial Sequence: Synthetic oligonucleotide"
ccgagcccccagggccgcc

SEQ ID NO: 4692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagcccccagggccgcctt

SEQ ID NO: 4693 - RNA, 19 nt, Artificial Sequence
  source: /note="Description of Artificial Sequence: Synthetic oligonucleotide"
gggcucgggccgggcgcgg

SEQ ID NO: 4694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcucgggccgggcgcggtt

SEQ ID NO: 4695 - RNA, 19 nt, Artificial Sequence
  source: /note="Description of Artificial Sequence: Synthetic oligonucleotide"
ccgcgcccggcccgagccc

SEQ ID NO: 4696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcgcccggcccgagccctt

SEQ ID NO: 4697 - RNA, 19 nt, Artificial Sequence
  source: /note="Description of Artificial Sequence: Synthetic oligonucleotide"
gcucgggccgggcgcggac

SEQ ID NO: 4698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucgggccgggcgcggactt

SEQ ID NO: 4699 - RNA, 19 nt, Artificial Sequence
  source: /note="Description of Artificial Sequence: Synthetic oligonucleotide"
guccgcgcccggcccgagc

SEQ ID NO: 4700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccgcgcccggcccgagctt

SEQ ID NO: 4701 - RNA, 19 nt, Artificial Sequence
  source: /note="Description of Artificial Sequence: Synthetic oligonucleotide"
cucgggccgggcgcggacc

SEQ ID NO: 4702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgggccgggcgcggacctt

SEQ ID NO: 4703 - RNA, 19 nt, Artificial Sequence
  source: /note="Description of Artificial Sequence: Synthetic oligonucleotide"
gguccgcgcccggcccgag

SEQ ID NO: 4704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccgcgcccggcccgagtt

SEQ ID NO: 4705 - RNA, 19 nt, Artificial Sequence
  source: /note="Description of Artificial Sequence: Synthetic oligonucleotide"
cggcggccccgggggcucg

SEQ ID NO: 4706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcggccccgggggcucgtt

SEQ ID NO: 4707 - RNA, 19 nt, Artificial Sequence
  source: /note="Description of Artificial Sequence: Synthetic oligonucleotide"
cgagcccccggggccgccg

SEQ ID NO: 4708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcccccggggccgccgtt

SEQ ID NO: 4709 - RNA, 19 nt, Artificial Sequence
  source: /note="Description of Artificial Sequence: Synthetic oligonucleotide"
gcggccccgggggcucggc

SEQ ID NO: 4710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggccccgggggcucggctt

SEQ ID NO: 4711 - RNA, 19 nt, Artificial Sequence
  source: /note="Description of Artificial Sequence: Synthetic oligonucleotide"
gccgagcccccggggccgc

SEQ ID NO: 4712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgagcccccggggccgctt

SEQ ID NO: 4713 - RNA, 19 nt, Artificial Sequence
  source: /note="Description of Artificial Sequence: Synthetic oligonucleotide"
cggccccgggggcucggcc

SEQ ID NO: 4714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccccgggggcucggcctt

SEQ ID NO: 4715 - RNA, 19 nt, Artificial Sequence
  source: /note="Description of Artificial Sequence: Synthetic oligonucleotide"
ggccgagcccccggggccg

SEQ ID NO: 4716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgagcccccggggccgtt

SEQ ID NO: 4717 - RNA, 19 nt, Artificial Sequence
  source: /note="Description of Artificial Sequence: Synthetic oligonucleotide"
cgggggcucggccucuggc

SEQ ID NO: 4718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggggcucggccucuggctt

SEQ ID NO: 4719 - RNA, 19 nt, Artificial Sequence
  source: /note="Description of Artificial Sequence: Synthetic oligonucleotide"
gccagaggccgagcccccg

SEQ ID NO: 4720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagaggccgagcccccgtt

SEQ ID NO: 4721 - RNA, 19 nt, Artificial Sequence
  source: /note="Description of Artificial Sequence: Synthetic oligonucleotide"
gggggcucggccucuggcc

SEQ ID NO: 4722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggcucggccucuggcctt

SEQ ID NO: 4723 - RNA, 19 nt, Artificial Sequence
  source: /note="Description of Artificial Sequence: Synthetic oligonucleotide"
ggccagaggccgagccccc

SEQ ID NO: 4724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccagaggccgagccccctt

SEQ ID NO: 4725 - RNA, 19 nt, Artificial Sequence
  source: /note="Description of Artificial Sequence: Synthetic oligonucleotide"
gggcucggccucuggccca

SEQ ID NO: 4726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcucggccucuggcccatt

SEQ ID NO: 4727 - RNA, 19 nt, Artificial Sequence
  source: /note="Description of Artificial Sequence: Synthetic oligonucleotide"
ugggccagaggccgagccc

SEQ ID NO: 4728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccagaggccgagccctt

SEQ ID NO: 4729 - RNA, 19 nt, Artificial Sequence
  source: /note="Description of Artificial Sequence: Synthetic oligonucleotide"
gcucggccucuggcccagg

SEQ ID NO: 4730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucggccucuggcccaggtt

SEQ ID NO: 4731 - RNA, 19 nt, Artificial Sequence
  source: /note="Description of Artificial Sequence: Synthetic oligonucleotide"
ccugggccagaggccgagc

SEQ ID NO: 4732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggccagaggccgagctt

SEQ ID NO: 4733 - RNA, 19 nt, Artificial Sequence
  source: /note="Description of Artificial Sequence: Synthetic oligonucleotide"
cucggccucuggcccagga

SEQ ID NO: 4734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggccucuggcccaggatt

SEQ ID NO: 4735 - RNA, 19 nt, Artificial Sequence
  source: /note="Description of Artificial Sequence: Synthetic oligonucleotide"
uccugggccagaggccgag

SEQ ID NO: 4736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugggccagaggccgagtt

SEQ ID NO: 4737 - RNA, 19 nt, Artificial Sequence
  source: /note="Description of Artificial Sequence: Synthetic oligonucleotide"
ucggccucuggcccaggag

SEQ ID NO: 4738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggccucuggcccaggagtt

SEQ ID NO: 4739 - RNA, 19 nt, Artificial Sequence
  source: /note="Description of Artificial Sequence: Synthetic oligonucleotide"
cuccugggccagaggccga

SEQ ID NO: 4740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccugggccagaggccgatt

SEQ ID NO: 4741 - RNA, 19 nt, Artificial Sequence
  source: /note="Description of Artificial Sequence: Synthetic oligonucleotide"
cggccucuggcccaggagg

SEQ ID NO: 4742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccucuggcccaggaggtt

SEQ ID NO: 4743 - RNA, 19 nt, Artificial Sequence
  source: /note="Description of Artificial Sequence: Synthetic oligonucleotide"
ccuccugggccagaggccg

SEQ ID NO: 4744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccugggccagaggccgtt

SEQ ID NO: 4745 - RNA, 19 nt, Artificial Sequence
  source: /note="Description of Artificial Sequence: Synthetic oligonucleotide"
gaggcacuggcggcgggaa

SEQ ID NO: 4746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcacuggcggcgggaatt

SEQ ID NO: 4747 - RNA, 19 nt, Artificial Sequence
  source: /note="Description of Artificial Sequence: Synthetic oligonucleotide"
uucccgccgccagugccuc

SEQ ID NO: 4748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccgccgccagugccuctt

SEQ ID NO: 4749 - RNA, 19 nt, Artificial Sequence
  source: /note="Description of Artificial Sequence: Synthetic oligonucleotide"
aaagcgucagucggggcua

SEQ ID NO: 4750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcgucagucggggcuatt

SEQ ID NO: 4751 - RNA, 19 nt, Artificial Sequence
  source: /note="Description of Artificial Sequence: Synthetic oligonucleotide"
uagccccgacugacgcuuu

SEQ ID NO: 4752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccccgacugacgcuuutt

SEQ ID NO: 4753 - RNA, 19 nt, Artificial Sequence
  source: /note="Description of Artificial Sequence: Synthetic oligonucleotide"
ucagucggggcuaugggug

SEQ ID NO: 4754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagucggggcuaugggugtt

SEQ ID NO: 4755 - RNA, 19 nt, Artificial Sequence
  source: /note="Description of Artificial Sequence: Synthetic oligonucleotide"
cacccauagccccgacuga

SEQ ID NO: 4756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacccauagccccgacugatt

SEQ ID NO: 4757 - RNA, 19 nt, Artificial Sequence
  source: /note="Description of Artificial Sequence: Synthetic oligonucleotide"
cagucggggcuaugggugg

SEQ ID NO: 4758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagucggggcuauggguggtt

SEQ ID NO: 4759 - RNA, 19 nt, Artificial Sequence
  source: /note="Description of Artificial Sequence: Synthetic oligonucleotide"
ccacccauagccccgacug

SEQ ID NO: 4760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacccauagccccgacugtt

SEQ ID NO: 4761 - RNA, 19 nt, Artificial Sequence
  source: /note="Description of Artificial Sequence: Synthetic oligonucleotide"
cggggcuaugggugggggc

SEQ ID NO: 4762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggcuaugggugggggctt

SEQ ID NO: 4763 - RNA, 19 nt, Artificial Sequence
  source: /note="Description of Artificial Sequence: Synthetic oligonucleotide"
gcccccacccauagccccg

SEQ ID NO: 4764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccacccauagccccgtt

SEQ ID NO: 4765 - RNA, 19 nt, Artificial Sequence
  source: /note="Description of Artificial Sequence: Synthetic oligonucleotide"
agccucgagcuccgggggu

SEQ ID NO: 4766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccucgagcuccgggggutt

SEQ ID NO: 4767 - RNA, 19 nt, Artificial Sequence
  source: /note="Description of Artificial Sequence: Synthetic oligonucleotide"
acccccggagcucgaggcu

SEQ ID NO: 4768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccccggagcucgaggcutt

SEQ ID NO: 4769 - RNA, 19 nt, Artificial Sequence
  source: /note="Description of Artificial Sequence: Synthetic oligonucleotide"
ucgagcuccggggguggcc

SEQ ID NO: 4770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgagcuccggggguggcctt

SEQ ID NO: 4771 - RNA, 19 nt, Artificial Sequence
  source: /note="Description of Artificial Sequence: Synthetic oligonucleotide"
ggccacccccggagcucga

SEQ ID NO: 4772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccacccccggagcucgatt

SEQ ID NO: 4773 - RNA, 19 nt, Artificial Sequence
  source: /note="Description of Artificial Sequence: Synthetic oligonucleotide"
cgagcuccggggguggccc

SEQ ID NO: 4774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcuccggggguggccctt

SEQ ID NO: 4775 - RNA, 19 nt, Artificial Sequence
  source: /note="Description of Artificial Sequence: Synthetic oligonucleotide"
gggccacccccggagcucg

SEQ ID NO: 4776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccacccccggagcucgtt

SEQ ID NO: 4777 - RNA, 19 nt, Artificial Sequence
  source: /note="Description of Artificial Sequence: Synthetic oligonucleotide"
uccggggguggccccagcg

SEQ ID NO: 4778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggggguggccccagcgtt

SEQ ID NO: 4779 - RNA, 19 nt, Artificial Sequence
  source: /note="Description of Artificial Sequence: Synthetic oligonucleotide"
cgcuggggccacccccgga

SEQ ID NO: 4780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcuggggccacccccggatt

SEQ ID NO: 4781 - RNA, 19 nt, Artificial Sequence
  source: /note="Description of Artificial Sequence: Synthetic oligonucleotide"
gccccagcggcagcggcgg

SEQ ID NO: 4782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccagcggcagcggcggtt

SEQ ID NO: 4783 - RNA, 19 nt, Artificial Sequence
  source: /note="Description of Artificial Sequence: Synthetic oligonucleotide"
ccgccgcugccgcuggggc

SEQ ID NO: 4784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgcugccgcuggggctt

SEQ ID NO: 4785 - RNA, 19 nt, Artificial Sequence
  source: /note="Description of Artificial Sequence: Synthetic oligonucleotide"
gcagcgguggccccggcgc

SEQ ID NO: 4786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcgguggccccggcgctt

SEQ ID NO: 4787 - RNA, 19 nt, Artificial Sequence
  source: /note="Description of Artificial Sequence: Synthetic oligonucleotide"
gcgccggggccaccgcugc

SEQ ID NO: 4788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgccggggccaccgcugctt

SEQ ID NO: 4789 - RNA, 19 nt, Artificial Sequence
  source: /note="Description of Artificial Sequence: Synthetic oligonucleotide"
cagcgguggccccggcgcg

SEQ ID NO: 4790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcgguggccccggcgcgtt

SEQ ID NO: 4791 - RNA, 19 nt, Artificial Sequence
  source: /note="Description of Artificial Sequence: Synthetic oligonucleotide"
cgcgccggggccaccgcug

SEQ ID NO: 4792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcgccggggccaccgcugtt

SEQ ID NO: 4793 - RNA, 19 nt, Artificial Sequence
  source: /note="Description of Artificial Sequence: Synthetic oligonucleotide"
gcgguggccccggcgcggg

SEQ ID NO: 4794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgguggccccggcgcgggtt

SEQ ID NO: 4795 - RNA, 19 nt, Artificial Sequence
  source: /note="Description of Artificial Sequence: Synthetic oligonucleotide"
cccgcgccggggccaccgc

SEQ ID NO: 4796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgcgccggggccaccgctt

SEQ ID NO: 4797 - RNA, 19 nt, Artificial Sequence
  source: /note="Description of Artificial Sequence: Synthetic oligonucleotide"
cgguggccccggcgcgggc

SEQ ID NO: 4798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguggccccggcgcgggctt

SEQ ID NO: 4799 - RNA, 19 nt, Artificial Sequence
  source: /note="Description of Artificial Sequence: Synthetic oligonucleotide"
gcccgcgccggggccaccg

SEQ ID NO: 4800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgcgccggggccaccgtt

SEQ ID NO: 4801 - RNA, 19 nt, Artificial Sequence
  source: /note="Description of Artificial Sequence: Synthetic oligonucleotide"
gguggccccggcgcgggca

SEQ ID NO: 4802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggccccggcgcgggcatt

SEQ ID NO: 4803 - RNA, 19 nt, Artificial Sequence
  source: /note="Description of Artificial Sequence: Synthetic oligonucleotide"
ugcccgcgccggggccacc

SEQ ID NO: 4804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccgcgccggggccacctt

SEQ ID NO: 4805 - RNA, 19 nt, Artificial Sequence
  source: /note="Description of Artificial Sequence: Synthetic oligonucleotide"
guggccccggcgcgggcac

SEQ ID NO: 4806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggccccggcgcgggcactt

SEQ ID NO: 4807 - RNA, 19 nt, Artificial Sequence
  source: /note="Description of Artificial Sequence: Synthetic oligonucleotide"
gugcccgcgccggggccac

SEQ ID NO: 4808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcccgcgccggggccactt

SEQ ID NO: 4809 - RNA, 19 nt, Artificial Sequence
  source: /note="Description of Artificial Sequence: Synthetic oligonucleotide"
uagcuucccgccgccggga

SEQ ID NO: 4810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcuucccgccgccgggatt

SEQ ID NO: 4811 - RNA, 19 nt, Artificial Sequence
  source: /note="Description of Artificial Sequence: Synthetic oligonucleotide"
ucccggcggcgggaagcua

SEQ ID NO: 4812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccggcggcgggaagcuatt

SEQ ID NO: 4813 - RNA, 19 nt, Artificial Sequence
  source: /note="Description of Artificial Sequence: Synthetic oligonucleotide"
ccgccgccgggagugaagc

SEQ ID NO: 4814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgccgggagugaagctt

SEQ ID NO: 4815 - RNA, 19 nt, Artificial Sequence
  source: /note="Description of Artificial Sequence: Synthetic oligonucleotide"
gcuucacucccggcggcgg

SEQ ID NO: 4816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucacucccggcggcggtt

SEQ ID NO: 4817 - RNA, 19 nt, Artificial Sequence
  source: /note="Description of Artificial Sequence: Synthetic oligonucleotide"
gccgggagugaagcugggc

SEQ ID NO: 4818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgggagugaagcugggctt

SEQ ID NO: 4819 - RNA, 19 nt, Artificial Sequence
  source: /note="Description of Artificial Sequence: Synthetic oligonucleotide"
gcccagcuucacucccggc

SEQ ID NO: 4820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagcuucacucccggctt

SEQ ID NO: 4821 - RNA, 19 nt, Artificial Sequence
  source: /note="Description of Artificial Sequence: Synthetic oligonucleotide"
cgggagugaagcugggccg

SEQ ID NO: 4822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggagugaagcugggccgtt

SEQ ID NO: 4823 - RNA, 19 nt, Artificial Sequence
  source: /note="Description of Artificial Sequence: Synthetic oligonucleotide"
cggcccagcuucacucccg

SEQ ID NO: 4824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcccagcuucacucccgtt

SEQ ID NO: 4825 - RNA, 19 nt, Artificial Sequence
  source: /note="Description of Artificial Sequence: Synthetic oligonucleotide"
gugaagcugggccgugaca

SEQ ID NO: 4826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaagcugggccgugacatt

SEQ ID NO: 4827 - RNA, 19 nt, Artificial Sequence
  source: /note="Description of Artificial Sequence: Synthetic oligonucleotide"
ugucacggcccagcuucac

SEQ ID NO: 4828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucacggcccagcuucactt

SEQ ID NO: 4829 - RNA, 19 nt, Artificial Sequence
  source: /note="Description of Artificial Sequence: Synthetic oligonucleotide"
gcugggccgugacagcggg

SEQ ID NO: 4830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggccgugacagcgggtt

SEQ ID NO: 4831 - RNA, 19 nt, Artificial Sequence
  source: /note="Description of Artificial Sequence: Synthetic oligonucleotide"
cccgcugucacggcccagc

SEQ ID NO: 4832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgcugucacggcccagctt

SEQ ID NO: 4833 - RNA, 19 nt, Artificial Sequence
  source: /note="Description of Artificial Sequence: Synthetic oligonucleotide"
acagcgggaaggugaccac

SEQ ID NO: 4834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcgggaaggugaccactt

SEQ ID NO: 4835 - RNA, 19 nt, Artificial Sequence
  source: /note="Description of Artificial Sequence: Synthetic oligonucleotide"
guggucaccuucccgcugu

SEQ ID NO: 4836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggucaccuucccgcugutt

SEQ ID NO: 4837 - RNA, 19 nt, Artificial Sequence
  source: /note="Description of Artificial Sequence: Synthetic oligonucleotide"
cgggaaggugaccacagug

SEQ ID NO: 4838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggaaggugaccacagugtt

SEQ ID NO: 4839 - RNA, 19 nt, Artificial Sequence
  source: /note="Description of Artificial Sequence: Synthetic oligonucleotide"
cacuguggucaccuucccg

SEQ ID NO: 4840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuguggucaccuucccgtt

SEQ ID NO: 4841 - RNA, 19 nt, Artificial Sequence
  source: /note="Description of Artificial Sequence: Synthetic oligonucleotide"
gugguagccacuguaggcc

SEQ ID NO: 4842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguagccacuguaggcctt

SEQ ID NO: 4843 - RNA, 19 nt, Artificial Sequence
  source: /note="Description of Artificial Sequence: Synthetic oligonucleotide"
ggccuacaguggcuaccac

SEQ ID NO: 4844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuacaguggcuaccactt

SEQ ID NO: 4845 - RNA, 19 nt, Artificial Sequence
  source: /note="Description of Artificial Sequence: Synthetic oligonucleotide"
ugguagccacuguaggcca

SEQ ID NO: 4846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguagccacuguaggccatt

SEQ ID NO: 4847 - RNA, 19 nt, Artificial Sequence
  source: /note="Description of Artificial Sequence: Synthetic oligonucleotide"
uggccuacaguggcuacca

SEQ ID NO: 4848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccuacaguggcuaccatt

SEQ ID NO: 4849 - RNA, 19 nt, Artificial Sequence
  source: /note="Description of Artificial Sequence: Synthetic oligonucleotide"
gguagccacuguaggccaa

SEQ ID NO: 4850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagccacuguaggccaatt

SEQ ID NO: 4851 - RNA, 19 nt, Artificial Sequence
  source: /note="Description of Artificial Sequence: Synthetic oligonucleotide"
uuggccuacaguggcuacc

SEQ ID NO: 4852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggccuacaguggcuacctt

SEQ ID NO: 4853 - RNA, 19 nt, Artificial Sequence
  source: /note="Description of Artificial Sequence: Synthetic oligonucleotide"
guagccacuguaggccaag

SEQ ID NO: 4854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagccacuguaggccaagtt

SEQ ID NO: 4855 - RNA, 19 nt, Artificial Sequence
  source: /note="Description of Artificial Sequence: Synthetic oligonucleotide"
cuuggccuacaguggcuac

SEQ ID NO: 4856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggccuacaguggcuactt

SEQ ID NO: 4857 - RNA, 19 nt, Artificial Sequence
  source: /note="Description of Artificial Sequence: Synthetic oligonucleotide"
cuguaggccaaggcccaga

SEQ ID NO: 4858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaggccaaggcccagatt

SEQ ID NO: 4859 - RNA, 19 nt, Artificial Sequence
  source: /note="Description of Artificial Sequence: Synthetic oligonucleotide"
ucugggccuuggccuacag

SEQ ID NO: 4860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugggccuuggccuacagtt

SEQ ID NO: 4861 - RNA, 19 nt, Artificial Sequence
  source: /note="Description of Artificial Sequence: Synthetic oligonucleotide"
gccaaggcccagagcguuc

SEQ ID NO: 4862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaaggcccagagcguuctt

SEQ ID NO: 4863 - RNA, 19 nt, Artificial Sequence
  source: /note="Description of Artificial Sequence: Synthetic oligonucleotide"
gaacgcucugggccuuggc

SEQ ID NO: 4864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacgcucugggccuuggctt

SEQ ID NO: 4865 - RNA, 19 nt, Artificial Sequence
  source: /note="Description of Artificial Sequence: Synthetic oligonucleotide"
ccaaggcccagagcguucc

SEQ ID NO: 4866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggcccagagcguucctt

SEQ ID NO: 4867 - RNA, 19 nt, Artificial Sequence
  source: /note="Description of Artificial Sequence: Synthetic oligonucleotide"
ggaacgcucugggccuugg

SEQ ID NO: 4868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacgcucugggccuuggtt

SEQ ID NO: 4869 - RNA, 19 nt, Artificial Sequence
  source: /note="Description of Artificial Sequence: Synthetic oligonucleotide"
guggcuuacacugacauca

SEQ ID NO: 4870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcuuacacugacaucatt

SEQ ID NO: 4871 - RNA, 19 nt, Artificial Sequence
  source: /note="Description of Artificial Sequence: Synthetic oligonucleotide"
ugaugucaguguaagccac

SEQ ID NO: 4872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaugucaguguaagccactt

SEQ ID NO: 4873 - RNA, 19 nt, Artificial Sequence
  source: /note="Description of Artificial Sequence: Synthetic oligonucleotide"
uggcuuacacugacaucaa

SEQ ID NO: 4874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuuacacugacaucaatt

SEQ ID NO: 4875 - RNA, 19 nt, Artificial Sequence
  source: /note="Description of Artificial Sequence: Synthetic oligonucleotide"
uugaugucaguguaagcca

SEQ ID NO: 4876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaugucaguguaagccatt

SEQ ID NO: 4877 - RNA, 19 nt, Artificial Sequence
  source: /note="Description of Artificial Sequence: Synthetic oligonucleotide"
gcuuacacugacaucaaag

SEQ ID NO: 4878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuacacugacaucaaagtt

SEQ ID NO: 4879 - RNA, 19 nt, Artificial Sequence
  source: /note="Description of Artificial Sequence: Synthetic oligonucleotide"
cuuugaugucaguguaagc

SEQ ID NO: 4880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugaugucaguguaagctt

SEQ ID NO: 4881 - RNA, 19 nt, Artificial Sequence
  source: /note="Description of Artificial Sequence: Synthetic oligonucleotide"
uacacugacaucaaaguga

SEQ ID NO: 4882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacugacaucaaagugatt

SEQ ID NO: 4883 - RNA, 19 nt, Artificial Sequence
  source: /note="Description of Artificial Sequence: Synthetic oligonucleotide"
ucacuuugaugucagugua

SEQ ID NO: 4884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacuuugaugucaguguatt

SEQ ID NO: 4885 - RNA, 19 nt, Artificial Sequence
  source: /note="Description of Artificial Sequence: Synthetic oligonucleotide"
caggcacggcuggcagaga

SEQ ID NO: 4886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcacggcuggcagagatt

SEQ ID NO: 4887 - RNA, 19 nt, Artificial Sequence
  source: /note="Description of Artificial Sequence: Synthetic oligonucleotide"
ucucugccagccgugccug

SEQ ID NO: 4888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucugccagccgugccugtt

SEQ ID NO: 4889 - RNA, 19 nt, Artificial Sequence
  source: /note="Description of Artificial Sequence: Synthetic oligonucleotide"
ggcagagacgagggaacug

SEQ ID NO: 4890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagagacgagggaacugtt

SEQ ID NO: 4891 - RNA, 19 nt, Artificial Sequence
  source: /note="Description of Artificial Sequence: Synthetic oligonucleotide"
caguucccucgucucugcc

SEQ ID NO: 4892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguucccucgucucugcctt

SEQ ID NO: 4893 - RNA, 19 nt, Artificial Sequence
  source: /note="Description of Artificial Sequence: Synthetic oligonucleotide"
cagagacgagggaacuggu

SEQ ID NO: 4894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagacgagggaacuggutt

SEQ ID NO: 4895 - RNA, 19 nt, Artificial Sequence
  source: /note="Description of Artificial Sequence: Synthetic oligonucleotide"
accaguucccucgucucug

SEQ ID NO: 4896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaguucccucgucucugtt

SEQ ID NO: 4897 - RNA, 19 nt, Artificial Sequence
  source: /note="Description of Artificial Sequence: Synthetic oligonucleotide"
ggaacugguggccaucaag

SEQ ID NO: 4898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacugguggccaucaagtt

SEQ ID NO: 4899 - RNA, 19 nt, Artificial Sequence
  source: /note="Description of Artificial Sequence: Synthetic oligonucleotide"
cuugauggccaccaguucc

SEQ ID NO: 4900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugauggccaccaguucctt

SEQ ID NO: 4901 - RNA, 19 nt, Artificial Sequence
  source: /note="Description of Artificial Sequence: Synthetic oligonucleotide"
gaacugguggccaucaaga

SEQ ID NO: 4902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacugguggccaucaagatt

SEQ ID NO: 4903 - RNA, 19 nt, Artificial Sequence
  source: /note="Description of Artificial Sequence: Synthetic oligonucleotide"
ucuugauggccaccaguuc

SEQ ID NO: 4904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuugauggccaccaguuctt

SEQ ID NO: 4905 - RNA, 19 nt, Artificial Sequence
  source: /note="Description of Artificial Sequence: Synthetic oligonucleotide"
aacugguggccaucaagaa

SEQ ID NO: 4906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugguggccaucaagaatt

SEQ ID NO: 4907 - RNA, 19 nt, Artificial Sequence
  source: /note="Description of Artificial Sequence: Synthetic oligonucleotide"
uucuugauggccaccaguu

SEQ ID NO: 4908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuugauggccaccaguutt

SEQ ID NO: 4909 - RNA, 19 nt, Artificial Sequence
  source: /note="Description of Artificial Sequence: Synthetic oligonucleotide"
guggccaucaagaagguuc

SEQ ID NO: 4910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggccaucaagaagguuctt

SEQ ID NO: 4911 - RNA, 19 nt, Artificial Sequence
  source: /note="Description of Artificial Sequence: Synthetic oligonucleotide"
gaaccuucuugauggccac

SEQ ID NO: 4912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccuucuugauggccactt

SEQ ID NO: 4913 - RNA, 19 nt, Artificial Sequence
  source: /note="Description of Artificial Sequence: Synthetic oligonucleotide"
uggccaucaagaagguucu

SEQ ID NO: 4914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccaucaagaagguucutt

SEQ ID NO: 4915 - RNA, 19 nt, Artificial Sequence
  source: /note="Description of Artificial Sequence: Synthetic oligonucleotide"
agaaccuucuugauggcca

SEQ ID NO: 4916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccuucuugauggccatt

SEQ ID NO: 4917 - RNA, 19 nt, Artificial Sequence
  source: /note="Description of Artificial Sequence: Synthetic oligonucleotide"
ggacaaaagguucaagaac

SEQ ID NO: 4918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaaaagguucaagaactt

SEQ ID NO: 4919 - RNA, 19 nt, Artificial Sequence
  source: /note="Description of Artificial Sequence: Synthetic oligonucleotide"
guucuugaaccuuuugucc

SEQ ID NO: 4920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuugaaccuuuugucctt

SEQ ID NO: 4921 - RNA, 19 nt, Artificial Sequence
  source: /note="Description of Artificial Sequence: Synthetic oligonucleotide"
gacaaaagguucaagaacc

SEQ ID NO: 4922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaaaagguucaagaacctt

SEQ ID NO: 4923 - RNA, 19 nt, Artificial Sequence
  source: /note="Description of Artificial Sequence: Synthetic oligonucleotide"
gguucuugaaccuuuuguc

SEQ ID NO: 4924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucuugaaccuuuuguctt

SEQ ID NO: 4925 - RNA, 19 nt, Artificial Sequence
  source: /note="Description of Artificial Sequence: Synthetic oligonucleotide"
cgagaacugcagauuaugc

SEQ ID NO: 4926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagaacugcagauuaugctt

SEQ ID NO: 4927 - RNA, 19 nt, Artificial Sequence
  source: /note="Description of Artificial Sequence: Synthetic oligonucleotide"
gcauaaucugcaguucucg

SEQ ID NO: 4928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcauaaucugcaguucucgtt

SEQ ID NO: 4929 - RNA, 19 nt, Artificial Sequence
  source: /note="Description of Artificial Sequence: Synthetic oligonucleotide"
gcugcgguacuuuuucuac

SEQ ID NO: 4930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcgguacuuuuucuactt

SEQ ID NO: 4931 - RNA, 19 nt, Artificial Sequence
  source: /note="Description of Artificial Sequence: Synthetic oligonucleotide"
guagaaaaaguaccgcagc

SEQ ID NO: 4932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaaaaaguaccgcagctt

SEQ ID NO: 4933 - RNA, 19 nt, Artificial Sequence
  source: /note="Description of Artificial Sequence: Synthetic oligonucleotide"
cgguacuuuuucuacucca

SEQ ID NO: 4934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguacuuuuucuacuccatt

SEQ ID NO: 4935 - RNA, 19 nt, Artificial Sequence
  source: /note="Description of Artificial Sequence: Synthetic oligonucleotide"
uggaguagaaaaaguaccg

SEQ ID NO: 4936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaguagaaaaaguaccgtt

SEQ ID NO: 4937 - RNA, 19 nt, Artificial Sequence
  source: /note="Description of Artificial Sequence: Synthetic oligonucleotide"
gggagaagaaggacgagcu

SEQ ID NO: 4938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagaagaaggacgagcutt

SEQ ID NO: 4939 - RNA, 19 nt, Artificial Sequence
  source: /note="Description of Artificial Sequence: Synthetic oligonucleotide"
agcucguccuucuucuccc

SEQ ID NO: 4940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucguccuucuucuccctt

SEQ ID NO: 4941 - RNA, 19 nt, Artificial Sequence
  source: /note="Description of Artificial Sequence: Synthetic oligonucleotide"
ggagaagaaggacgagcug

SEQ ID NO: 4942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaagaaggacgagcugtt

SEQ ID NO: 4943 - RNA, 19 nt, Artificial Sequence
  source: /note="Description of Artificial Sequence: Synthetic oligonucleotide"
cagcucguccuucuucucc

SEQ ID NO: 4944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcucguccuucuucucctt

SEQ ID NO: 4945 - RNA, 19 nt, Artificial Sequence
  source: /note="Description of Artificial Sequence: Synthetic oligonucleotide"
gguguaccgaguggcccgc

SEQ ID NO: 4946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguaccgaguggcccgctt

SEQ ID NO: 4947 - RNA, 19 nt, Artificial Sequence
  source: /note="Description of Artificial Sequence: Synthetic oligonucleotide"
gcgggccacucgguacacc

SEQ ID NO: 4948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggccacucgguacacctt

SEQ ID NO: 4949 - RNA, 19 nt, Artificial Sequence
  source: /note="Description of Artificial Sequence: Synthetic oligonucleotide"
uaccgaguggcccgccacu

SEQ ID NO: 4950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgaguggcccgccacutt

SEQ ID NO: 4951 - RNA, 19 nt, Artificial Sequence
  source: /note="Description of Artificial Sequence: Synthetic oligonucleotide"
aguggcgggccacucggua

SEQ ID NO: 4952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcgggccacucgguatt

SEQ ID NO: 4953 - RNA, 19 nt, Artificial Sequence
  source: /note="Description of Artificial Sequence: Synthetic oligonucleotide"
aaggccaagcugaucaccc

SEQ ID NO: 4954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggccaagcugaucaccctt

SEQ ID NO: 4955 - RNA, 19 nt, Artificial Sequence
  source: /note="Description of Artificial Sequence: Synthetic oligonucleotide"
gggugaucagcuuggccuu

SEQ ID NO: 4956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggugaucagcuuggccuutt

SEQ ID NO: 4957 - RNA, 19 nt, Artificial Sequence
  source: /note="Description of Artificial Sequence: Synthetic oligonucleotide"
aggccaagcugaucacccc

SEQ ID NO: 4958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccaagcugaucacccctt

SEQ ID NO: 4959 - RNA, 19 nt, Artificial Sequence
  source: /note="Description of Artificial Sequence: Synthetic oligonucleotide"
ggggugaucagcuuggccu

SEQ ID NO: 4960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggugaucagcuuggccutt

SEQ ID NO: 4961 - RNA, 19 nt, Artificial Sequence
  source: /note="Description of Artificial Sequence: Synthetic oligonucleotide"
aucuacaucaagguguaca

SEQ ID NO: 4962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuacaucaagguguacatt

SEQ ID NO: 4963 - RNA, 19 nt, Artificial Sequence
  source: /note="Description of Artificial Sequence: Synthetic oligonucleotide"
uguacaccuugauguagau

SEQ ID NO: 4964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacaccuugauguagautt

SEQ ID NO: 4965 - RNA, 19 nt, Artificial Sequence
  source: /note="Description of Artificial Sequence: Synthetic oligonucleotide"
ucuacaucaagguguacau

SEQ ID NO: 4966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacaucaagguguacautt

SEQ ID NO: 4967 - RNA, 19 nt, Artificial Sequence
  source: /note="Description of Artificial Sequence: Synthetic oligonucleotide"
auguacaccuugauguaga

SEQ ID NO: 4968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguacaccuugauguagatt

SEQ ID NO: 4969 - RNA, 19 nt, Artificial Sequence
  source: /note="Description of Artificial Sequence: Synthetic oligonucleotide"
cuacaucaagguguacaug

SEQ ID NO: 4970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaucaagguguacaugtt

SEQ ID NO: 4971 - RNA, 19 nt, Artificial Sequence
  source: /note="Description of Artificial Sequence: Synthetic oligonucleotide"
cauguacaccuugauguag

SEQ ID NO: 4972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauguacaccuugauguagtt

SEQ ID NO: 4973 - RNA, 19 nt, Artificial Sequence
  source: /note="Description of Artificial Sequence: Synthetic oligonucleotide"
uacaucaagguguacaugu

SEQ ID NO: 4974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaucaagguguacaugutt

SEQ ID NO: 4975 - RNA, 19 nt, Artificial Sequence
  source: /note="Description of Artificial Sequence: Synthetic oligonucleotide"
acauguacaccuugaugua

SEQ ID NO: 4976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauguacaccuugauguatt

SEQ ID NO: 4977 - RNA, 19 nt, Artificial Sequence
  source: /note="Description of Artificial Sequence: Synthetic oligonucleotide"
ccuacauccacucccaagg

SEQ ID NO: 4978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacauccacucccaaggtt

SEQ ID NO: 4979 - RNA, 19 nt, Artificial Sequence
  source: /note="Description of Artificial Sequence: Synthetic oligonucleotide"
ccuugggaguggauguagg

SEQ ID NO: 4980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugggaguggauguaggtt

SEQ ID NO: 4981 - RNA, 19 nt, Artificial Sequence
  source: /note="Description of Artificial Sequence: Synthetic oligonucleotide"
acauccacucccaaggugu

SEQ ID NO: 4982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauccacucccaaggugutt

SEQ ID NO: 4983 - RNA, 19 nt, Artificial Sequence
  source: /note="Description of Artificial Sequence: Synthetic oligonucleotide"
acaccuugggaguggaugu

SEQ ID NO: 4984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccuugggaguggaugutt

SEQ ID NO: 4985 - RNA, 19 nt, Artificial Sequence
  source: /note="Description of Artificial Sequence: Synthetic oligonucleotide"
cauccacucccaaggugug

SEQ ID NO: 4986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccacucccaaggugugtt

SEQ ID NO: 4987 - RNA, 19 nt, Artificial Sequence
  source: /note="Description of Artificial Sequence: Synthetic oligonucleotide"
cacaccuugggaguggaug

SEQ ID NO: 4988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaccuugggaguggaugtt

SEQ ID NO: 4989 - RNA, 19 nt, Artificial Sequence
  source: /note="Description of Artificial Sequence: Synthetic oligonucleotide"
aaggugugugucaccguga

SEQ ID NO: 4990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggugugugucaccgugatt

SEQ ID NO: 4991 - RNA, 19 nt, Artificial Sequence
  source: /note="Description of Artificial Sequence: Synthetic oligonucleotide"
ucacggugacacacaccuu

SEQ ID NO: 4992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacggugacacacaccuutt

SEQ ID NO: 4993 - RNA, 19 nt, Artificial Sequence
  source: /note="Description of Artificial Sequence: Synthetic oligonucleotide"
aggugugugucaccgugac

SEQ ID NO: 4994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggugugugucaccgugactt

SEQ ID NO: 4995 - RNA, 19 nt, Artificial Sequence
  source: /note="Description of Artificial Sequence: Synthetic oligonucleotide"
gucacggugacacacaccu

SEQ ID NO: 4996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucacggugacacacaccutt

SEQ ID NO: 4997 - RNA, 19 nt, Artificial Sequence
  source: /note="Description of Artificial Sequence: Synthetic oligonucleotide"
ggugugugucaccgugaca

SEQ ID NO: 4998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugugugucaccgugacatt

SEQ ID NO: 4999 - RNA, 19 nt, Artificial Sequence
  source: /note="Description of Artificial Sequence: Synthetic oligonucleotide"
ugucacggugacacacacc

SEQ ID NO: 5000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucacggugacacacacctt

SEQ ID NO: 5001 - RNA, 19 nt, Artificial Sequence
  source: /note="Description of Artificial Sequence: Synthetic oligonucleotide"
gugugugucaccgugacau

SEQ ID NO: 5002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugugugucaccgugacautt

SEQ ID NO: 5003 - RNA, 19 nt, Artificial Sequence
  source: /note="Description of Artificial Sequence: Synthetic oligonucleotide"
augucacggugacacacac

SEQ ID NO: 5004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augucacggugacacacactt

SEQ ID NO: 5005 - RNA, 19 nt, Artificial Sequence
  source: /note="Description of Artificial Sequence: Synthetic oligonucleotide"
ugugugucaccgugacauc

SEQ ID NO: 5006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugugucaccgugacauctt

SEQ ID NO: 5007 - RNA, 19 nt, Artificial Sequence
  source: /note="Description of Artificial Sequence: Synthetic oligonucleotide"
gaugucacggugacacaca

SEQ ID NO: 5008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugucacggugacacacatt

SEQ ID NO: 5009 - RNA, 19 nt, Artificial Sequence
  source: /note="Description of Artificial Sequence: Synthetic oligonucleotide"
gugugucaccgugacauca

SEQ ID NO: 5010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugugucaccgugacaucatt

SEQ ID NO: 5011 - RNA, 19 nt, Artificial Sequence
  source: /note="Description of Artificial Sequence: Synthetic oligonucleotide"
ugaugucacggugacacac

SEQ ID NO: 5012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaugucacggugacacactt

SEQ ID NO: 5013 - RNA, 19 nt, Artificial Sequence
  source: /note="Description of Artificial Sequence: Synthetic oligonucleotide"
ugugucaccgugacaucaa

SEQ ID NO: 5014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugucaccgugacaucaatt

SEQ ID NO: 5015 - RNA, 19 nt, Artificial Sequence
  source: /note="Description of Artificial Sequence: Synthetic oligonucleotide"
uugaugucacggugacaca

SEQ ID NO: 5016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaugucacggugacacatt

SEQ ID NO: 5017 - RNA, 19 nt, Artificial Sequence
  source: /note="Description of Artificial Sequence: Synthetic oligonucleotide"
gugacaucaagccccagaa

SEQ ID NO: 5018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugacaucaagccccagaatt

SEQ ID NO: 5019 - RNA, 19 nt, Artificial Sequence
  source: /note="Description of Artificial Sequence: Synthetic oligonucleotide"
uucuggggcuugaugucac

SEQ ID NO: 5020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuggggcuugaugucactt

SEQ ID NO: 5021 - RNA, 19 nt, Artificial Sequence
  source: /note="Description of Artificial Sequence: Synthetic oligonucleotide"
uggacccugacacugcugu

SEQ ID NO: 5022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacccugacacugcugutt

SEQ ID NO: 5023 - RNA, 19 nt, Artificial Sequence
  source: /note="Description of Artificial Sequence: Synthetic oligonucleotide"
acagcagugucagggucca

SEQ ID NO: 5024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcagugucaggguccatt

SEQ ID NO: 5025 - RNA, 19 nt, Artificial Sequence
  source: /note="Description of Artificial Sequence: Synthetic oligonucleotide"
cccugacacugcuguccuc

SEQ ID NO: 5026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugacacugcuguccuctt

SEQ ID NO: 5027 - RNA, 19 nt, Artificial Sequence
  source: /note="Description of Artificial Sequence: Synthetic oligonucleotide"
gaggacagcagugucaggg

SEQ ID NO: 5028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggacagcagugucagggtt

SEQ ID NO: 5029 - RNA, 19 nt, Artificial Sequence
  source: /note="Description of Artificial Sequence: Synthetic oligonucleotide"
acugcuguccucaagcucu

SEQ ID NO: 5030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcuguccucaagcucutt

SEQ ID NO: 5031 - RNA, 19 nt, Artificial Sequence
  source: /note="Description of Artificial Sequence: Synthetic oligonucleotide"
agagcuugaggacagcagu

SEQ ID NO: 5032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcuugaggacagcagutt

SEQ ID NO: 5033 - RNA, 19 nt, Artificial Sequence
  source: /note="Description of Artificial Sequence: Synthetic oligonucleotide"
cuguccucaagcucugcga

SEQ ID NO: 5034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguccucaagcucugcgatt

SEQ ID NO: 5035 - RNA, 19 nt, Artificial Sequence
  source: /note="Description of Artificial Sequence: Synthetic oligonucleotide"
ucgcagagcuugaggacag

SEQ ID NO: 5036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgcagagcuugaggacagtt

SEQ ID NO: 5037 - RNA, 19 nt, Artificial Sequence
  source: /note="Description of Artificial Sequence: Synthetic oligonucleotide"
uguccucaagcucugcgau

SEQ ID NO: 5038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccucaagcucugcgautt

SEQ ID NO: 5039 - RNA, 19 nt, Artificial Sequence
  source: /note="Description of Artificial Sequence: Synthetic oligonucleotide"
aucgcagagcuugaggaca

SEQ ID NO: 5040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgcagagcuugaggacatt

SEQ ID NO: 5041 - RNA, 19 nt, Artificial Sequence
  source: /note="Description of Artificial Sequence: Synthetic oligonucleotide"
guguccuacaucugcucuc

SEQ ID NO: 5042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguccuacaucugcucuctt

SEQ ID NO: 5043 - RNA, 19 nt, Artificial Sequence
  source: /note="Description of Artificial Sequence: Synthetic oligonucleotide"
gagagcagauguaggacac

SEQ ID NO: 5044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagcagauguaggacactt

SEQ ID NO: 5045 - RNA, 19 nt, Artificial Sequence
  source: /note="Description of Artificial Sequence: Synthetic oligonucleotide"
aucugcucucgguacuacc

SEQ ID NO: 5046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugcucucgguacuacctt

SEQ ID NO: 5047 - RNA, 19 nt, Artificial Sequence
  source: /note="Description of Artificial Sequence: Synthetic oligonucleotide"
gguaguaccgagagcagau

SEQ ID NO: 5048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguaguaccgagagcagautt

SEQ ID NO: 5049 - RNA, 19 nt, Artificial Sequence
  source: /note="Description of Artificial Sequence: Synthetic oligonucleotide"
gugcuccagaacucaucuu

SEQ ID NO: 5050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcuccagaacucaucuutt

SEQ ID NO: 5051 - RNA, 19 nt, Artificial Sequence
  source: /note="Description of Artificial Sequence: Synthetic oligonucleotide"
aagaugaguucuggagcac

SEQ ID NO: 5052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaugaguucuggagcactt

SEQ ID NO: 5053 - RNA, 19 nt, Artificial Sequence
  source: /note="Description of Artificial Sequence: Synthetic oligonucleotide"
ugcuccagaacucaucuuu

SEQ ID NO: 5054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuccagaacucaucuuutt

SEQ ID NO: 5055 - RNA, 19 nt, Artificial Sequence
  source: /note="Description of Artificial Sequence: Synthetic oligonucleotide"
aaagaugaguucuggagca

SEQ ID NO: 5056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagaugaguucuggagcatt

SEQ ID NO: 5057 - RNA, 19 nt, Artificial Sequence
  source: /note="Description of Artificial Sequence: Synthetic oligonucleotide"
gcuccagaacucaucuuug

SEQ ID NO: 5058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccagaacucaucuuugtt

SEQ ID NO: 5059 - RNA, 19 nt, Artificial Sequence
  source: /note="Description of Artificial Sequence: Synthetic oligonucleotide"
caaagaugaguucuggagc

SEQ ID NO: 5060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagaugaguucuggagctt

SEQ ID NO: 5061 - RNA, 19 nt, Artificial Sequence
  source: /note="Description of Artificial Sequence: Synthetic oligonucleotide"
cucaucuuuggagccacag

SEQ ID NO: 5062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaucuuuggagccacagtt

SEQ ID NO: 5063 - RNA, 19 nt, Artificial Sequence
  source: /note="Description of Artificial Sequence: Synthetic oligonucleotide"
cuguggcuccaaagaugag

SEQ ID NO: 5064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggcuccaaagaugagtt

SEQ ID NO: 5065 - RNA, 19 nt, Artificial Sequence
  source: /note="Description of Artificial Sequence: Synthetic oligonucleotide"
cguccaucgaugugugguc

SEQ ID NO: 5066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguccaucgaugugugguctt

SEQ ID NO: 5067 - RNA, 19 nt, Artificial Sequence
  source: /note="Description of Artificial Sequence: Synthetic oligonucleotide"
gaccacacaucgauggacg

SEQ ID NO: 5068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccacacaucgauggacgtt

SEQ ID NO: 5069 - RNA, 19 nt, Artificial Sequence
  source: /note="Description of Artificial Sequence: Synthetic oligonucleotide"
auguguggucggcuggcug

SEQ ID NO: 5070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguguggucggcuggcugtt

SEQ ID NO: 5071 - RNA, 19 nt, Artificial Sequence
  source: /note="Description of Artificial Sequence: Synthetic oligonucleotide"
cagccagccgaccacacau

SEQ ID NO: 5072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccagccgaccacacautt

SEQ ID NO: 5073 - RNA, 19 nt, Artificial Sequence
  source: /note="Description of Artificial Sequence: Synthetic oligonucleotide"
acuucucggccagcccauc

SEQ ID NO: 5074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucucggccagcccauctt

SEQ ID NO: 5075 - RNA, 19 nt, Artificial Sequence
  source: /note="Description of Artificial Sequence: Synthetic oligonucleotide"
gaugggcuggccgagaagu

SEQ ID NO: 5076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugggcuggccgagaagutt

SEQ ID NO: 5077 - RNA, 19 nt, Artificial Sequence
  source: /note="Description of Artificial Sequence: Synthetic oligonucleotide"
cucggccagcccaucuucc

SEQ ID NO: 5078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggccagcccaucuucctt

SEQ ID NO: 5079 - RNA, 19 nt, Artificial Sequence
  source: /note="Description of Artificial Sequence: Synthetic oligonucleotide"
ggaagaugggcuggccgag

SEQ ID NO: 5080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagaugggcuggccgagtt

SEQ ID NO: 5081 - RNA, 19 nt, Artificial Sequence
  source: /note="Description of Artificial Sequence: Synthetic oligonucleotide"
agcccaucuucccugggga

SEQ ID NO: 5082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaucuucccuggggatt

SEQ ID NO: 5083 - RNA, 19 nt, Artificial Sequence
  source: /note="Description of Artificial Sequence: Synthetic oligonucleotide"
uccccagggaagaugggcu

SEQ ID NO: 5084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccagggaagaugggcutt

SEQ ID NO: 5085 - RNA, 19 nt, Artificial Sequence
  source: /note="Description of Artificial Sequence: Synthetic oligonucleotide"
ccaucuucccuggggacag

SEQ ID NO: 5086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucuucccuggggacagtt

SEQ ID NO: 5087 - RNA, 19 nt, Artificial Sequence
  source: /note="Description of Artificial Sequence: Synthetic oligonucleotide"
cuguccccagggaagaugg

SEQ ID NO: 5088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguccccagggaagauggtt

SEQ ID NO: 5089 - RNA, 19 nt, Artificial Sequence
  source: /note="Description of Artificial Sequence: Synthetic oligonucleotide"
cccuggggacaguggggug

SEQ ID NO: 5090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggggacaguggggugtt

SEQ ID NO: 5091 - RNA, 19 nt, Artificial Sequence
  source: /note="Description of Artificial Sequence: Synthetic oligonucleotide"
caccccacuguccccaggg

SEQ ID NO: 5092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccccacuguccccagggtt

SEQ ID NO: 5093 - RNA, 19 nt, Artificial Sequence
  source: /note="Description of Artificial Sequence: Synthetic oligonucleotide"
gggacagugggguggacca

SEQ ID NO: 5094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggacagugggguggaccatt

SEQ ID NO: 5095 - RNA, 19 nt, Artificial Sequence
  source: /note="Description of Artificial Sequence: Synthetic oligonucleotide"
ugguccaccccacuguccc

SEQ ID NO: 5096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguccaccccacuguccctt

SEQ ID NO: 5097 - RNA, 19 nt, Artificial Sequence
  source: /note="Description of Artificial Sequence: Synthetic oligonucleotide"
ggacagugggguggaccag

SEQ ID NO: 5098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacagugggguggaccagtt

SEQ ID NO: 5099 - RNA, 19 nt, Artificial Sequence
  source: /note="Description of Artificial Sequence: Synthetic oligonucleotide"
cugguccaccccacugucc

SEQ ID NO: 5100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguccaccccacugucctt

SEQ ID NO: 5101 - RNA, 19 nt, Artificial Sequence
  source: /note="Description of Artificial Sequence: Synthetic oligonucleotide"
gacagugggguggaccagc

SEQ ID NO: 5102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacagugggguggaccagctt

SEQ ID NO: 5103 - RNA, 19 nt, Artificial Sequence
  source: /note="Description of Artificial Sequence: Synthetic oligonucleotide"
gcugguccaccccacuguc

SEQ ID NO: 5104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguccaccccacuguctt

SEQ ID NO: 5105 - RNA, 19 nt, Artificial Sequence
  source: /note="Description of Artificial Sequence: Synthetic oligonucleotide"
acagugggguggaccagcu

SEQ ID NO: 5106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagugggguggaccagcutt

SEQ ID NO: 5107 - RNA, 19 nt, Artificial Sequence
  source: /note="Description of Artificial Sequence: Synthetic oligonucleotide"
agcugguccaccccacugu

SEQ ID NO: 5108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugguccaccccacugutt

SEQ ID NO: 5109 - RNA, 19 nt, Artificial Sequence
  source: /note="Description of Artificial Sequence: Synthetic oligonucleotide"
cagugggguggaccagcuu

SEQ ID NO: 5110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugggguggaccagcuutt

SEQ ID NO: 5111 - RNA, 19 nt, Artificial Sequence
  source: /note="Description of Artificial Sequence: Synthetic oligonucleotide"
aagcugguccaccccacug

SEQ ID NO: 5112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcugguccaccccacugtt

SEQ ID NO: 5113 - RNA, 19 nt, Artificial Sequence
  source: /note="Description of Artificial Sequence: Synthetic oligonucleotide"
uacggaguucaaguucccc

SEQ ID NO: 5114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacggaguucaaguucccctt

SEQ ID NO: 5115 - RNA, 19 nt, Artificial Sequence
  source: /note="Description of Artificial Sequence: Synthetic oligonucleotide"
ggggaacuugaacuccgua

SEQ ID NO: 5116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaacuugaacuccguatt

SEQ ID NO: 5117 - RNA, 19 nt, Artificial Sequence
  source: /note="Description of Artificial Sequence: Synthetic oligonucleotide"
cggaguucaaguuccccca

SEQ ID NO: 5118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaguucaaguucccccatt

SEQ ID NO: 5119 - RNA, 19 nt, Artificial Sequence
  source: /note="Description of Artificial Sequence: Synthetic oligonucleotide"
ugggggaacuugaacuccg

SEQ ID NO: 5120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggggaacuugaacuccgtt

SEQ ID NO: 5121 - RNA, 19 nt, Artificial Sequence
  source: /note="Description of Artificial Sequence: Synthetic oligonucleotide"
cucacccuuggacaaaggu

SEQ ID NO: 5122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucacccuuggacaaaggutt

SEQ ID NO: 5123 - RNA, 19 nt, Artificial Sequence
  source: /note="Description of Artificial Sequence: Synthetic oligonucleotide"
accuuuguccaagggugag

SEQ ID NO: 5124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuuguccaagggugagtt

SEQ ID NO: 5125 - RNA, 19 nt, Artificial Sequence
  source: /note="Description of Artificial Sequence: Synthetic oligonucleotide"
cacccuuggacaaaggugu

SEQ ID NO: 5126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacccuuggacaaaggugutt

SEQ ID NO: 5127 - RNA, 19 nt, Artificial Sequence
  source: /note="Description of Artificial Sequence: Synthetic oligonucleotide"
acaccuuuguccaagggug

SEQ ID NO: 5128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccuuuguccaagggugtt

SEQ ID NO: 5129 - RNA, 19 nt, Artificial Sequence
  source: /note="Description of Artificial Sequence: Synthetic oligonucleotide"
ccuuggacaaagguguuca

SEQ ID NO: 5130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuggacaaagguguucatt

SEQ ID NO: 5131 - RNA, 19 nt, Artificial Sequence
  source: /note="Description of Artificial Sequence: Synthetic oligonucleotide"
ugaacaccuuuguccaagg

SEQ ID NO: 5132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacaccuuuguccaaggtt

SEQ ID NO: 5133 - RNA, 19 nt, Artificial Sequence
  source: /note="Description of Artificial Sequence: Synthetic oligonucleotide"
cuuggacaaagguguucaa

SEQ ID NO: 5134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggacaaagguguucaatt

SEQ ID NO: 5135 - RNA, 19 nt, Artificial Sequence
  source: /note="Description of Artificial Sequence: Synthetic oligonucleotide"
uugaacaccuuuguccaag

SEQ ID NO: 5136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaacaccuuuguccaagtt

SEQ ID NO: 5137 - RNA, 19 nt, Artificial Sequence
  source: /note="Description of Artificial Sequence: Synthetic oligonucleotide"
agguguucaaaucuucaaa

SEQ ID NO: 5138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguguucaaaucuucaaatt

SEQ ID NO: 5139 - RNA, 19 nt, Artificial Sequence
  source: /note="Description of Artificial Sequence: Synthetic oligonucleotide"
uuugaagauuugaacaccu

SEQ ID NO: 5140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaagauuugaacaccutt

SEQ ID NO: 5141 - RNA, 19 nt, Artificial Sequence
  source: /note="Description of Artificial Sequence: Synthetic oligonucleotide"
uguucaaaucuucaaagac

SEQ ID NO: 5142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucaaaucuucaaagactt

SEQ ID NO: 5143 - RNA, 19 nt, Artificial Sequence
  source: /note="Description of Artificial Sequence: Synthetic oligonucleotide"
gucuuugaagauuugaaca

SEQ ID NO: 5144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuuugaagauuugaacatt

SEQ ID NO: 5145 - RNA, 19 nt, Artificial Sequence
  source: /note="Description of Artificial Sequence: Synthetic oligonucleotide"
guucaaaucuucaaagaca

SEQ ID NO: 5146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaaaucuucaaagacatt

SEQ ID NO: 5147 - RNA, 19 nt, Artificial Sequence
  source: /note="Description of Artificial Sequence: Synthetic oligonucleotide"
ugucuuugaagauuugaac

SEQ ID NO: 5148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucuuugaagauuugaactt

SEQ ID NO: 5149 - RNA, 19 nt, Artificial Sequence
  source: /note="Description of Artificial Sequence: Synthetic oligonucleotide"
uucaaaucuucaaagacac

SEQ ID NO: 5150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaaaucuucaaagacactt

SEQ ID NO: 5151 - RNA, 19 nt, Artificial Sequence
  source: /note="Description of Artificial Sequence: Synthetic oligonucleotide"
gugucuuugaagauuugaa

SEQ ID NO: 5152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucuuugaagauuugaatt

SEQ ID NO: 5153 - RNA, 19 nt, Artificial Sequence
  source: /note="Description of Artificial Sequence: Synthetic oligonucleotide"
ucaaaucuucaaagacacc

SEQ ID NO: 5154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaaucuucaaagacacctt

SEQ ID NO: 5155 - RNA, 19 nt, Artificial Sequence
  source: /note="Description of Artificial Sequence: Synthetic oligonucleotide"
ggugucuuugaagauuuga

SEQ ID NO: 5156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugucuuugaagauuugatt

SEQ ID NO: 5157 - RNA, 19 nt, Artificial Sequence
  source: /note="Description of Artificial Sequence: Synthetic oligonucleotide"
ccugaggccauugcacucu

SEQ ID NO: 5158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugaggccauugcacucutt

SEQ ID NO: 5159 - RNA, 19 nt, Artificial Sequence
  source: /note="Description of Artificial Sequence: Synthetic oligonucleotide"
agagugcaauggccucagg

SEQ ID NO: 5160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagugcaauggccucaggtt

SEQ ID NO: 5161 - RNA, 19 nt, Artificial Sequence
  source: /note="Description of Artificial Sequence: Synthetic oligonucleotide"
gccauugcacucugcucua

SEQ ID NO: 5162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccauugcacucugcucuatt

SEQ ID NO: 5163 - RNA, 19 nt, Artificial Sequence
  source: /note="Description of Artificial Sequence: Synthetic oligonucleotide"
uagagcagagugcaauggc

SEQ ID NO: 5164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagagcagagugcaauggctt

SEQ ID NO: 5165 - RNA, 19 nt, Artificial Sequence
  source: /note="Description of Artificial Sequence: Synthetic oligonucleotide"
cuagccuacuggaguacac

SEQ ID NO: 5166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagccuacuggaguacactt

SEQ ID NO: 5167 - RNA, 19 nt, Artificial Sequence
  source: /note="Description of Artificial Sequence: Synthetic oligonucleotide"
guguacuccaguaggcuag

SEQ ID NO: 5168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacuccaguaggcuagtt

SEQ ID NO: 5169 - RNA, 19 nt, Artificial Sequence
  source: /note="Description of Artificial Sequence: Synthetic oligonucleotide"
acgccauccucaaggcucu

SEQ ID NO: 5170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgccauccucaaggcucutt

SEQ ID NO: 5171 - RNA, 19 nt, Artificial Sequence
  source: /note="Description of Artificial Sequence: Synthetic oligonucleotide"
agagccuugaggauggcgu

SEQ ID NO: 5172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagccuugaggauggcgutt

SEQ ID NO: 5173 - RNA, 19 nt, Artificial Sequence
  source: /note="Description of Artificial Sequence: Synthetic oligonucleotide"
gccauccucaaggcucucc

SEQ ID NO: 5174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccauccucaaggcucucctt

SEQ ID NO: 5175 - RNA, 19 nt, Artificial Sequence
  source: /note="Description of Artificial Sequence: Synthetic oligonucleotide"
ggagagccuugaggauggc

SEQ ID NO: 5176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagagccuugaggauggctt

SEQ ID NO: 5177 - RNA, 19 nt, Artificial Sequence
  source: /note="Description of Artificial Sequence: Synthetic oligonucleotide"
uccucaaggcucuccccac

SEQ ID NO: 5178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucaaggcucuccccactt

SEQ ID NO: 5179 - RNA, 19 nt, Artificial Sequence
  source: /note="Description of Artificial Sequence: Synthetic oligonucleotide"
guggggagagccuugagga

SEQ ID NO: 5180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggggagagccuugaggatt

SEQ ID NO: 5181 - RNA, 19 nt, Artificial Sequence
  source: /note="Description of Artificial Sequence: Synthetic oligonucleotide"
ccccacucgaggcuugugc

SEQ ID NO: 5182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccacucgaggcuugugctt

SEQ ID NO: 5183 - RNA, 19 nt, Artificial Sequence
  source: /note="Description of Artificial Sequence: Synthetic oligonucleotide"
gcacaagccucgagugggg

SEQ ID NO: 5184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacaagccucgaguggggtt

SEQ ID NO: 5185 - RNA, 19 nt, Artificial Sequence
  source: /note="Description of Artificial Sequence: Synthetic oligonucleotide"
cccacucgaggcuugugcc

SEQ ID NO: 5186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacucgaggcuugugcctt

SEQ ID NO: 5187 - RNA, 19 nt, Artificial Sequence
  source: /note="Description of Artificial Sequence: Synthetic oligonucleotide"
ggcacaagccucgaguggg

SEQ ID NO: 5188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacaagccucgagugggtt

SEQ ID NO: 5189 - RNA, 19 nt, Artificial Sequence
  source: /note="Description of Artificial Sequence: Synthetic oligonucleotide"
ccacucgaggcuugugccc

SEQ ID NO: 5190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacucgaggcuugugccctt

SEQ ID NO: 5191 - RNA, 19 nt, Artificial Sequence
  source: /note="Description of Artificial Sequence: Synthetic oligonucleotide"
gggcacaagccucgagugg

SEQ ID NO: 5192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcacaagccucgaguggtt

SEQ ID NO: 5193 - RNA, 19 nt, Artificial Sequence
  source: /note="Description of Artificial Sequence: Synthetic oligonucleotide"
acucgaggcuugugcccac

SEQ ID NO: 5194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucgaggcuugugcccactt

SEQ ID NO: 5195 - RNA, 19 nt, Artificial Sequence
  source: /note="Description of Artificial Sequence: Synthetic oligonucleotide"
gugggcacaagccucgagu

SEQ ID NO: 5196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugggcacaagccucgagutt

SEQ ID NO: 5197 - RNA, 19 nt, Artificial Sequence
  source: /note="Description of Artificial Sequence: Synthetic oligonucleotide"
cucgaggcuugugcccaca

SEQ ID NO: 5198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgaggcuugugcccacatt

SEQ ID NO: 5199 - RNA, 19 nt, Artificial Sequence
  source: /note="Description of Artificial Sequence: Synthetic oligonucleotide"
ugugggcacaagccucgag

SEQ ID NO: 5200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugggcacaagccucgagtt

SEQ ID NO: 5201 - RNA, 19 nt, Artificial Sequence
  source: /note="Description of Artificial Sequence: Synthetic oligonucleotide"
ucgaggcuugugcccacag

SEQ ID NO: 5202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaggcuugugcccacagtt

SEQ ID NO: 5203 - RNA, 19 nt, Artificial Sequence
  source: /note="Description of Artificial Sequence: Synthetic oligonucleotide"
cugugggcacaagccucga

SEQ ID NO: 5204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugggcacaagccucgatt

SEQ ID NO: 5205 - RNA, 19 nt, Artificial Sequence
  source: /note="Description of Artificial Sequence: Synthetic oligonucleotide"
gcccacagcuucuucgaug

SEQ ID NO: 5206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccacagcuucuucgaugtt

SEQ ID NO: 5207 - RNA, 19 nt, Artificial Sequence
  source: /note="Description of Artificial Sequence: Synthetic oligonucleotide"
caucgaagaagcugugggc

SEQ ID NO: 5208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucgaagaagcugugggctt

SEQ ID NO: 5209 - RNA, 19 nt, Artificial Sequence
  source: /note="Description of Artificial Sequence: Synthetic oligonucleotide"
ccacagcuucuucgaugaa

SEQ ID NO: 5210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagcuucuucgaugaatt

SEQ ID NO: 5211 - RNA, 19 nt, Artificial Sequence
  source: /note="Description of Artificial Sequence: Synthetic oligonucleotide"
uucaucgaagaagcugugg

SEQ ID NO: 5212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaucgaagaagcuguggtt

SEQ ID NO: 5213 - RNA, 19 nt, Artificial Sequence
  source: /note="Description of Artificial Sequence: Synthetic oligonucleotide"
gagcccagcuccccaacga

SEQ ID NO: 5214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccagcuccccaacgatt

SEQ ID NO: 5215 - RNA, 19 nt, Artificial Sequence
  source: /note="Description of Artificial Sequence: Synthetic oligonucleotide"
ucguuggggagcugggcuc

SEQ ID NO: 5216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucguuggggagcugggcuctt

SEQ ID NO: 5217 - RNA, 19 nt, Artificial Sequence
  source: /note="Description of Artificial Sequence: Synthetic oligonucleotide"
caguccuggugaacugucc

SEQ ID NO: 5218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguccuggugaacugucctt

SEQ ID NO: 5219 - RNA, 19 nt, Artificial Sequence
  source: /note="Description of Artificial Sequence: Synthetic oligonucleotide"
ggacaguucaccaggacug

SEQ ID NO: 5220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaguucaccaggacugtt

SEQ ID NO: 5221 - RNA, 19 nt, Artificial Sequence
  source: /note="Description of Artificial Sequence: Synthetic oligonucleotide"
guccauccaaccaucucuc

SEQ ID NO: 5222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccauccaaccaucucuctt

SEQ ID NO: 5223 - RNA, 19 nt, Artificial Sequence
  source: /note="Description of Artificial Sequence: Synthetic oligonucleotide"
gagagaugguuggauggac

SEQ ID NO: 5224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagaugguuggauggactt

SEQ ID NO: 5225 - RNA, 19 nt, Artificial Sequence
  source: /note="Description of Artificial Sequence: Synthetic oligonucleotide"
aucucucaaugccauucuc

SEQ ID NO: 5226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucucucaaugccauucuctt

SEQ ID NO: 5227 - RNA, 19 nt, Artificial Sequence
  source: /note="Description of Artificial Sequence: Synthetic oligonucleotide"
gagaauggcauugagagau

SEQ ID NO: 5228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaauggcauugagagautt

SEQ ID NO: 5229 - RNA, 19 nt, Artificial Sequence
  source: /note="Description of Artificial Sequence: Synthetic oligonucleotide"
cucucaaugccauucucau

SEQ ID NO: 5230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucaaugccauucucautt

SEQ ID NO: 5231 - RNA, 19 nt, Artificial Sequence
  source: /note="Description of Artificial Sequence: Synthetic oligonucleotide"
augagaauggcauugagag

SEQ ID NO: 5232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augagaauggcauugagagtt

SEQ ID NO: 5233 - RNA, 19 nt, Artificial Sequence
  source: /note="Description of Artificial Sequence: Synthetic oligonucleotide"
ucucaaugccauucucauc

SEQ ID NO: 5234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucaaugccauucucauctt

SEQ ID NO: 5235 - RNA, 19 nt, Artificial Sequence
  source: /note="Description of Artificial Sequence: Synthetic oligonucleotide"
gaugagaauggcauugaga

SEQ ID NO: 5236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugagaauggcauugagatt

SEQ ID NO: 5237 - RNA, 19 nt, Artificial Sequence
  source: /note="Description of Artificial Sequence: Synthetic oligonucleotide"
caaugccauucucaucccu

SEQ ID NO: 5238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaugccauucucaucccutt

SEQ ID NO: 5239 - RNA, 19 nt, Artificial Sequence
  source: /note="Description of Artificial Sequence: Synthetic oligonucleotide"
agggaugagaauggcauug

SEQ ID NO: 5240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaugagaauggcauugtt

SEQ ID NO: 5241 - RNA, 19 nt, Artificial Sequence
  source: /note="Description of Artificial Sequence: Synthetic oligonucleotide"
aggcccugcuucuccccuc

SEQ ID NO: 5242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcccugcuucuccccuctt

SEQ ID NO: 5243 - RNA, 19 nt, Artificial Sequence
  source: /note="Description of Artificial Sequence: Synthetic oligonucleotide"
gaggggagaagcagggccu

SEQ ID NO: 5244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggggagaagcagggccutt

SEQ ID NO: 5245 - RNA, 19 nt, Artificial Sequence
  source: /note="Description of Artificial Sequence: Synthetic oligonucleotide"
ggcccugcuucuccccuca

SEQ ID NO: 5246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccugcuucuccccucatt

SEQ ID NO: 5247 - RNA, 19 nt, Artificial Sequence
  source: /note="Description of Artificial Sequence: Synthetic oligonucleotide"
ugaggggagaagcagggcc

SEQ ID NO: 5248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggggagaagcagggcctt

SEQ ID NO: 5249 - RNA, 19 nt, Artificial Sequence
  source: /note="Description of Artificial Sequence: Synthetic oligonucleotide"
gcuucuccccucaccacuu

SEQ ID NO: 5250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucuccccucaccacuutt

SEQ ID NO: 5251 - RNA, 19 nt, Artificial Sequence
  source: /note="Description of Artificial Sequence: Synthetic oligonucleotide"
aaguggugaggggagaagc

SEQ ID NO: 5252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguggugaggggagaagctt

SEQ ID NO: 5253 - RNA, 19 nt, Artificial Sequence
  source: /note="Description of Artificial Sequence: Synthetic oligonucleotide"
cuucuccccucaccacuuc

SEQ ID NO: 5254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuccccucaccacuuctt

SEQ ID NO: 5255 - RNA, 19 nt, Artificial Sequence
  source: /note="Description of Artificial Sequence: Synthetic oligonucleotide"
gaaguggugaggggagaag

SEQ ID NO: 5256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaguggugaggggagaagtt

SEQ ID NO: 5257 - RNA, 19 nt, Artificial Sequence
  source: /note="Description of Artificial Sequence: Synthetic oligonucleotide"
cuccccucaccacuuccua

SEQ ID NO: 5258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccucaccacuuccuatt

SEQ ID NO: 5259 - RNA, 19 nt, Artificial Sequence
  source: /note="Description of Artificial Sequence: Synthetic oligonucleotide"
uaggaaguggugaggggag

SEQ ID NO: 5260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggaaguggugaggggagtt

SEQ ID NO: 5261 - RNA, 19 nt, Artificial Sequence
  source: /note="Description of Artificial Sequence: Synthetic oligonucleotide"
cucaccacuuccuacaacc

SEQ ID NO: 5262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaccacuuccuacaacctt

SEQ ID NO: 5263 - RNA, 19 nt, Artificial Sequence
  source: /note="Description of Artificial Sequence: Synthetic oligonucleotide"
gguuguaggaaguggugag

SEQ ID NO: 5264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuguaggaaguggugagtt

SEQ ID NO: 5265 - RNA, 19 nt, Artificial Sequence
  source: /note="Description of Artificial Sequence: Synthetic oligonucleotide"
ccauccucacaagcuuuaa

SEQ ID NO: 5266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauccucacaagcuuuaatt

SEQ ID NO: 5267 - RNA, 19 nt, Artificial Sequence
  source: /note="Description of Artificial Sequence: Synthetic oligonucleotide"
uuaaagcuugugaggaugg

SEQ ID NO: 5268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaagcuugugaggauggtt

SEQ ID NO: 5269 - RNA, 19 nt, Artificial Sequence
  source: /note="Description of Artificial Sequence: Synthetic oligonucleotide"
cucagacuggccaagauug

SEQ ID NO: 5270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucagacuggccaagauugtt

SEQ ID NO: 5271 - RNA, 19 nt, Artificial Sequence
  source: /note="Description of Artificial Sequence: Synthetic oligonucleotide"
caaucuuggccagucugag

SEQ ID NO: 5272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaucuuggccagucugagtt

SEQ ID NO: 5273 - RNA, 19 nt, Artificial Sequence
  source: /note="Description of Artificial Sequence: Synthetic oligonucleotide"
uuggcagccaucugaugcc

SEQ ID NO: 5274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcagccaucugaugcctt

SEQ ID NO: 5275 - RNA, 19 nt, Artificial Sequence
  source: /note="Description of Artificial Sequence: Synthetic oligonucleotide"
ggcaucagauggcugccaa

SEQ ID NO: 5276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaucagauggcugccaatt

SEQ ID NO: 5277 - RNA, 19 nt, Artificial Sequence
  source: /note="Description of Artificial Sequence: Synthetic oligonucleotide"
uggcagccaucugaugcca

SEQ ID NO: 5278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcagccaucugaugccatt

SEQ ID NO: 5279 - RNA, 19 nt, Artificial Sequence
  source: /note="Description of Artificial Sequence: Synthetic oligonucleotide"
uggcaucagauggcugcca

SEQ ID NO: 5280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcaucagauggcugccatt

SEQ ID NO: 5281 - RNA, 19 nt, Artificial Sequence
  source: /note="Description of Artificial Sequence: Synthetic oligonucleotide"
ggcagccaucugaugccac

SEQ ID NO: 5282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagccaucugaugccactt

SEQ ID NO: 5283 - RNA, 19 nt, Artificial Sequence
  source: /note="Description of Artificial Sequence: Synthetic oligonucleotide"
guggcaucagauggcugcc

SEQ ID NO: 5284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcaucagauggcugcctt

SEQ ID NO: 5285 - RNA, 19 nt, Artificial Sequence
  source: /note="Description of Artificial Sequence: Synthetic oligonucleotide"
gcagccaucugaugccaca

SEQ ID NO: 5286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagccaucugaugccacatt

SEQ ID NO: 5287 - RNA, 19 nt, Artificial Sequence
  source: /note="Description of Artificial Sequence: Synthetic oligonucleotide"
uguggcaucagauggcugc

SEQ ID NO: 5288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggcaucagauggcugctt

SEQ ID NO: 5289 - RNA, 19 nt, Artificial Sequence
  source: /note="Description of Artificial Sequence: Synthetic oligonucleotide"
gccaucugaugccacaacu

SEQ ID NO: 5290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaucugaugccacaacutt

SEQ ID NO: 5291 - RNA, 19 nt, Artificial Sequence
  source: /note="Description of Artificial Sequence: Synthetic oligonucleotide"
aguuguggcaucagauggc

SEQ ID NO: 5292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuguggcaucagauggctt

SEQ ID NO: 5293 - RNA, 19 nt, Artificial Sequence
  source: /note="Description of Artificial Sequence: Synthetic oligonucleotide"
cucgcuagcucuuccugag

SEQ ID NO: 5294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgcuagcucuuccugagtt

SEQ ID NO: 5295 - RNA, 19 nt, Artificial Sequence
  source: /note="Description of Artificial Sequence: Synthetic oligonucleotide"
cucaggaagagcuagcgag

SEQ ID NO: 5296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaggaagagcuagcgagtt

SEQ ID NO: 5297 - RNA, 19 nt, Artificial Sequence
  source: /note="Description of Artificial Sequence: Synthetic oligonucleotide"
ucgcuagcucuuccugagg

SEQ ID NO: 5298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgcuagcucuuccugaggtt

SEQ ID NO: 5299 - RNA, 19 nt, Artificial Sequence
  source: /note="Description of Artificial Sequence: Synthetic oligonucleotide"
ccucaggaagagcuagcga

SEQ ID NO: 5300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaggaagagcuagcgatt

SEQ ID NO: 5301 - RNA, 19 nt, Artificial Sequence
  source: /note="Description of Artificial Sequence: Synthetic oligonucleotide"
cgcuagcucuuccugaggg

SEQ ID NO: 5302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcuagcucuuccugagggtt

SEQ ID NO: 5303 - RNA, 19 nt, Artificial Sequence
  source: /note="Description of Artificial Sequence: Synthetic oligonucleotide"
cccucaggaagagcuagcg

SEQ ID NO: 5304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucaggaagagcuagcgtt

SEQ ID NO: 5305 - RNA, 19 nt, Artificial Sequence
  source: /note="Description of Artificial Sequence: Synthetic oligonucleotide"
uuccugagggccccaccga

SEQ ID NO: 5306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccugagggccccaccgatt

SEQ ID NO: 5307 - RNA, 19 nt, Artificial Sequence
  source: /note="Description of Artificial Sequence: Synthetic oligonucleotide"
ucgguggggcccucaggaa

SEQ ID NO: 5308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguggggcccucaggaatt

SEQ ID NO: 5309 - RNA, 19 nt, Artificial Sequence
  source: /note="Description of Artificial Sequence: Synthetic oligonucleotide"
cugagggccccaccgacua

SEQ ID NO: 5310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugagggccccaccgacuatt

SEQ ID NO: 5311 - RNA, 19 nt, Artificial Sequence
  source: /note="Description of Artificial Sequence: Synthetic oligonucleotide"
uagucgguggggcccucag

SEQ ID NO: 5312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagucgguggggcccucagtt

SEQ ID NO: 5313 - RNA, 19 nt, Artificial Sequence
  source: /note="Description of Artificial Sequence: Synthetic oligonucleotide"
ugagggccccaccgacuac

SEQ ID NO: 5314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagggccccaccgacuactt

SEQ ID NO: 5315 - RNA, 19 nt, Artificial Sequence
  source: /note="Description of Artificial Sequence: Synthetic oligonucleotide"
guagucgguggggcccuca

SEQ ID NO: 5316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagucgguggggcccucatt

SEQ ID NO: 5317 - RNA, 19 nt, Artificial Sequence
  source: /note="Description of Artificial Sequence: Synthetic oligonucleotide"
gagggccccaccgacuacc

SEQ ID NO: 5318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggccccaccgacuacctt

SEQ ID NO: 5319 - RNA, 19 nt, Artificial Sequence
  source: /note="Description of Artificial Sequence: Synthetic oligonucleotide"
gguagucgguggggcccuc

SEQ ID NO: 5320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagucgguggggcccuctt

SEQ ID NO: 5321 - RNA, 19 nt, Artificial Sequence
  source: /note="Description of Artificial Sequence: Synthetic oligonucleotide"
aucuaggccucccucagca

SEQ ID NO: 5322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuaggccucccucagcatt

SEQ ID NO: 5323 - RNA, 19 nt, Artificial Sequence
  source: /note="Description of Artificial Sequence: Synthetic oligonucleotide"
ugcugagggaggccuagau

SEQ ID NO: 5324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcugagggaggccuagautt

SEQ ID NO: 5325 - RNA, 19 nt, Artificial Sequence
  source: /note="Description of Artificial Sequence: Synthetic oligonucleotide"
ccucccucagcagccuaac

SEQ ID NO: 5326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucccucagcagccuaactt

SEQ ID NO: 5327 - RNA, 19 nt, Artificial Sequence
  source: /note="Description of Artificial Sequence: Synthetic oligonucleotide"
guuaggcugcugagggagg

SEQ ID NO: 5328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaggcugcugagggaggtt

SEQ ID NO: 5329 - RNA, 19 nt, Artificial Sequence
  source: /note="Description of Artificial Sequence: Synthetic oligonucleotide"
gccuaaccucugugguggg

SEQ ID NO: 5330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuaaccucuguggugggtt

SEQ ID NO: 5331 - RNA, 19 nt, Artificial Sequence
  source: /note="Description of Artificial Sequence: Synthetic oligonucleotide"
cccaccacagagguuaggc

SEQ ID NO: 5332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaccacagagguuaggctt

SEQ ID NO: 5333 - RNA, 19 nt, Artificial Sequence
  source: /note="Description of Artificial Sequence: Synthetic oligonucleotide"
aacuguuuguaggggaggg

SEQ ID NO: 5334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuguuuguaggggagggtt

SEQ ID NO: 5335 - RNA, 19 nt, Artificial Sequence
  source: /note="Description of Artificial Sequence: Synthetic oligonucleotide"
cccuccccuacaaacaguu

SEQ ID NO: 5336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuccccuacaaacaguutt

SEQ ID NO: 5337 - RNA, 19 nt, Artificial Sequence
  source: /note="Description of Artificial Sequence: Synthetic oligonucleotide"
guuuguaggggaggggaga

SEQ ID NO: 5338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuguaggggaggggagatt

SEQ ID NO: 5339 - RNA, 19 nt, Artificial Sequence
  source: /note="Description of Artificial Sequence: Synthetic oligonucleotide"
ucuccccuccccuacaaac

SEQ ID NO: 5340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccccuccccuacaaactt

SEQ ID NO: 5341 - RNA, 19 nt, Artificial Sequence
  source: /note="Description of Artificial Sequence: Synthetic oligonucleotide"
guaggggaggggagaaaag

SEQ ID NO: 5342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggggaggggagaaaagtt

SEQ ID NO: 5343 - RNA, 19 nt, Artificial Sequence
  source: /note="Description of Artificial Sequence: Synthetic oligonucleotide"
cuuuucuccccuccccuac

SEQ ID NO: 5344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuucuccccuccccuactt

SEQ ID NO: 5345 - RNA, 19 nt, Artificial Sequence
  source: /note="Description of Artificial Sequence: Synthetic oligonucleotide"
aaaggaaggacgggguuug

SEQ ID NO: 5346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaggaaggacgggguuugtt

SEQ ID NO: 5347 - RNA, 19 nt, Artificial Sequence
  source: /note="Description of Artificial Sequence: Synthetic oligonucleotide"
caaaccccguccuuccuuu

SEQ ID NO: 5348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaccccguccuuccuuutt

SEQ ID NO: 5349 - RNA, 19 nt, Artificial Sequence
  source: /note="Description of Artificial Sequence: Synthetic oligonucleotide"
aaggaaggacgggguuugg

SEQ ID NO: 5350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggaaggacgggguuuggtt

SEQ ID NO: 5351 - RNA, 19 nt, Artificial Sequence
  source: /note="Description of Artificial Sequence: Synthetic oligonucleotide"
ccaaaccccguccuuccuu

SEQ ID NO: 5352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaaccccguccuuccuutt

SEQ ID NO: 5353 - RNA, 19 nt, Artificial Sequence
  source: /note="Description of Artificial Sequence: Synthetic oligonucleotide"
aggaaggacgggguuuggg

SEQ ID NO: 5354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaaggacgggguuugggtt

SEQ ID NO: 5355 - RNA, 19 nt, Artificial Sequence
  source: /note="Description of Artificial Sequence: Synthetic oligonucleotide"
cccaaaccccguccuuccu

SEQ ID NO: 5356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaaaccccguccuuccutt

SEQ ID NO: 5357 - RNA, 19 nt, Artificial Sequence
  source: /note="Description of Artificial Sequence: Synthetic oligonucleotide"
aggaccuucuacccccuug

SEQ ID NO: 5358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaccuucuacccccuugtt

SEQ ID NO: 5359 - RNA, 19 nt, Artificial Sequence
  source: /note="Description of Artificial Sequence: Synthetic oligonucleotide"
caaggggguagaagguccu

SEQ ID NO: 5360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggggguagaagguccutt

SEQ ID NO: 5361 - RNA, 19 nt, Artificial Sequence
  source: /note="Description of Artificial Sequence: Synthetic oligonucleotide"
ggaccuucuacccccuugg

SEQ ID NO: 5362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccuucuacccccuuggtt

SEQ ID NO: 5363 - RNA, 19 nt, Artificial Sequence
  source: /note="Description of Artificial Sequence: Synthetic oligonucleotide"
ccaaggggguagaaggucc

SEQ ID NO: 5364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggggguagaaggucctt

SEQ ID NO: 5365 - RNA, 19 nt, Artificial Sequence
  source: /note="Description of Artificial Sequence: Synthetic oligonucleotide"
gaccuucuacccccuuggu

SEQ ID NO: 5366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccuucuacccccuuggutt

SEQ ID NO: 5367 - RNA, 19 nt, Artificial Sequence
  source: /note="Description of Artificial Sequence: Synthetic oligonucleotide"
accaaggggguagaagguc

SEQ ID NO: 5368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaaggggguagaagguctt

SEQ ID NO: 5369 - RNA, 19 nt, Artificial Sequence
  source: /note="Description of Artificial Sequence: Synthetic oligonucleotide"
accuucuacccccuugguc

SEQ ID NO: 5370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuucuacccccuugguctt

SEQ ID NO: 5371 - RNA, 19 nt, Artificial Sequence
  source: /note="Description of Artificial Sequence: Synthetic oligonucleotide"
gaccaaggggguagaaggu

SEQ ID NO: 5372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccaaggggguagaaggutt

SEQ ID NO: 5373 - RNA, 19 nt, Artificial Sequence
  source: /note="Description of Artificial Sequence: Synthetic oligonucleotide"
ccuucuacccccuuggucc

SEQ ID NO: 5374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucuacccccuuggucctt

SEQ ID NO: 5375 - RNA, 19 nt, Artificial Sequence
  source: /note="Description of Artificial Sequence: Synthetic oligonucleotide"
ggaccaaggggguagaagg

SEQ ID NO: 5376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccaaggggguagaaggtt

SEQ ID NO: 5377 - RNA, 19 nt, Artificial Sequence
  source: /note="Description of Artificial Sequence: Synthetic oligonucleotide"
cuucuacccccuugguccc

SEQ ID NO: 5378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuacccccuugguccctt

SEQ ID NO: 5379 - RNA, 19 nt, Artificial Sequence
  source: /note="Description of Artificial Sequence: Synthetic oligonucleotide"
gggaccaaggggguagaag

SEQ ID NO: 5380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaccaaggggguagaagtt

SEQ ID NO: 5381 - RNA, 19 nt, Artificial Sequence
  source: /note="Description of Artificial Sequence: Synthetic oligonucleotide"
ccccucccccaggcuacca

SEQ ID NO: 5382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccucccccaggcuaccatt

SEQ ID NO: 5383 - RNA, 19 nt, Artificial Sequence
  source: /note="Description of Artificial Sequence: Synthetic oligonucleotide"
ugguagccugggggagggg

SEQ ID NO: 5384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguagccugggggaggggtt

SEQ ID NO: 5385 - RNA, 19 nt, Artificial Sequence
  source: /note="Description of Artificial Sequence: Synthetic oligonucleotide"
aggcuaccacuccuucccu

SEQ ID NO: 5386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuaccacuccuucccutt

SEQ ID NO: 5387 - RNA, 19 nt, Artificial Sequence
  source: /note="Description of Artificial Sequence: Synthetic oligonucleotide"
agggaaggagugguagccu

SEQ ID NO: 5388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaaggagugguagccutt

SEQ ID NO: 5389 - RNA, 19 nt, Artificial Sequence
  source: /note="Description of Artificial Sequence: Synthetic oligonucleotide"
ggcuaccacuccuucccuc

SEQ ID NO: 5390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuaccacuccuucccuctt

SEQ ID NO: 5391 - RNA, 19 nt, Artificial Sequence
  source: /note="Description of Artificial Sequence: Synthetic oligonucleotide"
gagggaaggagugguagcc

SEQ ID NO: 5392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaaggagugguagcctt

SEQ ID NO: 5393 - RNA, 19 nt, Artificial Sequence
  source: /note="Description of Artificial Sequence: Synthetic oligonucleotide"
ccucccccccucucccagg

SEQ ID NO: 5394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucccccccucucccaggtt

SEQ ID NO: 5395 - RNA, 19 nt, Artificial Sequence
  source: /note="Description of Artificial Sequence: Synthetic oligonucleotide"
ccugggagagggggggagg

SEQ ID NO: 5396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggagagggggggaggtt

SEQ ID NO: 5397 - RNA, 19 nt, Artificial Sequence
  source: /note="Description of Artificial Sequence: Synthetic oligonucleotide"
cccccccucucccaggucc

SEQ ID NO: 5398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccccucucccaggucctt

SEQ ID NO: 5399 - RNA, 19 nt, Artificial Sequence
  source: /note="Description of Artificial Sequence: Synthetic oligonucleotide"
ggaccugggagaggggggg

SEQ ID NO: 5400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccugggagagggggggtt

SEQ ID NO: 5401 - RNA, 19 nt, Artificial Sequence
  source: /note="Description of Artificial Sequence: Synthetic oligonucleotide"
ccucucccaggucccuugu

SEQ ID NO: 5402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucucccaggucccuugutt

SEQ ID NO: 5403 - RNA, 19 nt, Artificial Sequence
  source: /note="Description of Artificial Sequence: Synthetic oligonucleotide"
acaagggaccugggagagg

SEQ ID NO: 5404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagggaccugggagaggtt

SEQ ID NO: 5405 - RNA, 19 nt, Artificial Sequence
  source: /note="Description of Artificial Sequence: Synthetic oligonucleotide"
ccaggucccuuguaaauag

SEQ ID NO: 5406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggucccuuguaaauagtt

SEQ ID NO: 5407 - RNA, 19 nt, Artificial Sequence
  source: /note="Description of Artificial Sequence: Synthetic oligonucleotide"
cuauuuacaagggaccugg

SEQ ID NO: 5408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauuuacaagggaccuggtt

SEQ ID NO: 5409 - RNA, 19 nt, Artificial Sequence
  source: /note="Description of Artificial Sequence: Synthetic oligonucleotide"
agaaccagcccagcccauc

SEQ ID NO: 5410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccagcccagcccauctt

SEQ ID NO: 5411 - RNA, 19 nt, Artificial Sequence
  source: /note="Description of Artificial Sequence: Synthetic oligonucleotide"
gaugggcugggcugguucu

SEQ ID NO: 5412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugggcugggcugguucutt

SEQ ID NO: 5413 - RNA, 19 nt, Artificial Sequence
  source: /note="Description of Artificial Sequence: Synthetic oligonucleotide"
gaaccagcccagcccaucu

SEQ ID NO: 5414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccagcccagcccaucutt

SEQ ID NO: 5415 - RNA, 19 nt, Artificial Sequence
  source: /note="Description of Artificial Sequence: Synthetic oligonucleotide"
agaugggcugggcugguuc

SEQ ID NO: 5416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugggcugggcugguuctt

SEQ ID NO: 5417 - RNA, 19 nt, Artificial Sequence
  source: /note="Description of Artificial Sequence: Synthetic oligonucleotide"
aaccagcccagcccaucuc

SEQ ID NO: 5418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccagcccagcccaucuctt

SEQ ID NO: 5419 - RNA, 19 nt, Artificial Sequence
  source: /note="Description of Artificial Sequence: Synthetic oligonucleotide"
gagaugggcugggcugguu

SEQ ID NO: 5420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaugggcugggcugguutt

SEQ ID NO: 5421 - RNA, 19 nt, Artificial Sequence
  source: /note="Description of Artificial Sequence: Synthetic oligonucleotide"
accagcccagcccaucucu

SEQ ID NO: 5422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcccagcccaucucutt

SEQ ID NO: 5423 - RNA, 19 nt, Artificial Sequence
  source: /note="Description of Artificial Sequence: Synthetic oligonucleotide"
agagaugggcugggcuggu

SEQ ID NO: 5424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagaugggcugggcuggutt

SEQ ID NO: 5425 - RNA, 19 nt, Artificial Sequence
  source: /note="Description of Artificial Sequence: Synthetic oligonucleotide"
ccagcccagcccaucucuc

SEQ ID NO: 5426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcccagcccaucucuctt

SEQ ID NO: 5427 - RNA, 19 nt, Artificial Sequence
  source: /note="Description of Artificial Sequence: Synthetic oligonucleotide"
gagagaugggcugggcugg

SEQ ID NO: 5428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagaugggcugggcuggtt

SEQ ID NO: 5429 - RNA, 19 nt, Artificial Sequence
  source: /note="Description of Artificial Sequence: Synthetic oligonucleotide"
cucucgucuucccuucccu

SEQ ID NO: 5430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucgucuucccuucccutt

SEQ ID NO: 5431 - RNA, 19 nt, Artificial Sequence
  source: /note="Description of Artificial Sequence: Synthetic oligonucleotide"
agggaagggaagacgagag

SEQ ID NO: 5432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaagggaagacgagagtt

SEQ ID NO: 5433 - RNA, 19 nt, Artificial Sequence
  source: /note="Description of Artificial Sequence: Synthetic oligonucleotide"
ucucgucuucccuucccug

SEQ ID NO: 5434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgucuucccuucccugtt

SEQ ID NO: 5435 - RNA, 19 nt, Artificial Sequence
  source: /note="Description of Artificial Sequence: Synthetic oligonucleotide"
cagggaagggaagacgaga

SEQ ID NO: 5436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggaagggaagacgagatt

SEQ ID NO: 5437 - RNA, 19 nt, Artificial Sequence
  source: /note="Description of Artificial Sequence: Synthetic oligonucleotide"
ucuucccuucccuggcccc

SEQ ID NO: 5438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucccuucccuggcccctt

SEQ ID NO: 5439 - RNA, 19 nt, Artificial Sequence
  source: /note="Description of Artificial Sequence: Synthetic oligonucleotide"
ggggccagggaagggaaga

SEQ ID NO: 5440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccagggaagggaagatt

SEQ ID NO: 5441 - RNA, 19 nt, Artificial Sequence
  source: /note="Description of Artificial Sequence: Synthetic oligonucleotide"
cuucccuucccuggccccc

SEQ ID NO: 5442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccuucccuggccccctt

SEQ ID NO: 5443 - RNA, 19 nt, Artificial Sequence
  source: /note="Description of Artificial Sequence: Synthetic oligonucleotide"
gggggccagggaagggaag

SEQ ID NO: 5444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggccagggaagggaagtt

SEQ ID NO: 5445 - RNA, 19 nt, Artificial Sequence
  source: /note="Description of Artificial Sequence: Synthetic oligonucleotide"
ucccuggcccccugggugu

SEQ ID NO: 5446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuggcccccugggugutt

SEQ ID NO: 5447 - RNA, 19 nt, Artificial Sequence
  source: /note="Description of Artificial Sequence: Synthetic oligonucleotide"
acacccagggggccaggga

SEQ ID NO: 5448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacccagggggccagggatt

SEQ ID NO: 5449 - RNA, 19 nt, Artificial Sequence
  source: /note="Description of Artificial Sequence: Synthetic oligonucleotide"
guaaauagauuguuauaau

SEQ ID NO: 5450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaauagauuguuauaautt

SEQ ID NO: 5451 - RNA, 19 nt, Artificial Sequence
  source: /note="Description of Artificial Sequence: Synthetic oligonucleotide"
auuauaacaaucuauuuac

SEQ ID NO: 5452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuauaacaaucuauuuactt

SEQ ID NO: 5453 - RNA, 19 nt, Artificial Sequence
  source: /note="Description of Artificial Sequence: Synthetic oligonucleotide"
uguuauaauuuuuucuuaa

SEQ ID NO: 5454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuauaauuuuuucuuaatt

SEQ ID NO: 5455 - RNA, 19 nt, Artificial Sequence
  source: /note="Description of Artificial Sequence: Synthetic oligonucleotide"
uuaagaaaaaauuauaaca

SEQ ID NO: 5456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaagaaaaaauuauaacatt

SEQ ID NO: 5457 - RNA, 19 nt, Artificial Sequence
  source: /note="Description of Artificial Sequence: Synthetic oligonucleotide"
gcuguaccccuucuugucc

SEQ ID NO: 5458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguaccccuucuugucctt

SEQ ID NO: 5459 - RNA, 19 nt, Artificial Sequence
  source: /note="Description of Artificial Sequence: Synthetic oligonucleotide"
ggacaagaagggguacagc

SEQ ID NO: 5460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaagaagggguacagctt

SEQ ID NO: 5461 - RNA, 19 nt, Artificial Sequence
  source: /note="Description of Artificial Sequence: Synthetic oligonucleotide"
guaccccuucuuguccucu

SEQ ID NO: 5462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccccuucuuguccucutt

SEQ ID NO: 5463 - RNA, 19 nt, Artificial Sequence
  source: /note="Description of Artificial Sequence: Synthetic oligonucleotide"
agaggacaagaagggguac

SEQ ID NO: 5464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggacaagaagggguactt

SEQ ID NO: 5465 - RNA, 19 nt, Artificial Sequence
  source: /note="Description of Artificial Sequence: Synthetic oligonucleotide"
uguccucugcucccaaggc

SEQ ID NO: 5466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccucugcucccaaggctt

SEQ ID NO: 5467 - RNA, 19 nt, Artificial Sequence
  source: /note="Description of Artificial Sequence: Synthetic oligonucleotide"
gccuugggagcagaggaca

SEQ ID NO: 5468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuugggagcagaggacatt

SEQ ID NO: 5469 - RNA, 19 nt, Artificial Sequence
  source: /note="Description of Artificial Sequence: Synthetic oligonucleotide"
aguagagagagucccuggu

SEQ ID NO: 5470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguagagagagucccuggutt

SEQ ID NO: 5471 - RNA, 19 nt, Artificial Sequence
  source: /note="Description of Artificial Sequence: Synthetic oligonucleotide"
accagggacucucucuacu

SEQ ID NO: 5472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagggacucucucuacutt

SEQ ID NO: 5473 - RNA, 19 nt, Artificial Sequence
  source: /note="Description of Artificial Sequence: Synthetic oligonucleotide"
gucccuggugucuuaguuu

SEQ ID NO: 5474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucccuggugucuuaguuutt

SEQ ID NO: 5475 - RNA, 19 nt, Artificial Sequence
  source: /note="Description of Artificial Sequence: Synthetic oligonucleotide"
aaacuaagacaccagggac

SEQ ID NO: 5476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacuaagacaccagggactt

SEQ ID NO: 5477 - RNA, 19 nt, Artificial Sequence
  source: /note="Description of Artificial Sequence: Synthetic oligonucleotide"
gugucuuaguuuccacagu

SEQ ID NO: 5478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucuuaguuuccacagutt

SEQ ID NO: 5479 - RNA, 19 nt, Artificial Sequence
  source: /note="Description of Artificial Sequence: Synthetic oligonucleotide"
acuguggaaacuaagacac

SEQ ID NO: 5480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguggaaacuaagacactt

SEQ ID NO: 5481 - RNA, 19 nt, Artificial Sequence
  source: /note="Description of Artificial Sequence: Synthetic oligonucleotide"
gucuuaguuuccacaguaa

SEQ ID NO: 5482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuuaguuuccacaguaatt

SEQ ID NO: 5483 - RNA, 19 nt, Artificial Sequence
  source: /note="Description of Artificial Sequence: Synthetic oligonucleotide"
uuacuguggaaacuaagac

SEQ ID NO: 5484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacuguggaaacuaagactt

SEQ ID NO: 5485 - RNA, 19 nt, Artificial Sequence
  source: /note="Description of Artificial Sequence: Synthetic oligonucleotide"
ucuuaguuuccacaguaag

SEQ ID NO: 5486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuaguuuccacaguaagtt

SEQ ID NO: 5487 - RNA, 19 nt, Artificial Sequence
  source: /note="Description of Artificial Sequence: Synthetic oligonucleotide"
cuuacuguggaaacuaaga

SEQ ID NO: 5488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuacuguggaaacuaagatt

SEQ ID NO: 5489 - RNA, 19 nt, Artificial Sequence
  source: /note="Description of Artificial Sequence: Synthetic oligonucleotide"
accucuguucaauaaauua

SEQ ID NO: 5490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucuguucaauaaauuatt

SEQ ID NO: 5491 - RNA, 19 nt, Artificial Sequence
  source: /note="Description of Artificial Sequence: Synthetic oligonucleotide"
uaauuuauugaacagaggu

SEQ ID NO: 5492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauuuauugaacagaggutt

SEQ ID NO: 5493 - RNA, 19 nt, Artificial Sequence
  source: /note="Description of Artificial Sequence: Synthetic oligonucleotide"
aaauuauuggcaugaaacc

SEQ ID NO: 5494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauuauuggcaugaaacctt

SEQ ID NO: 5495 - RNA, 19 nt, Artificial Sequence
  source: /note="Description of Artificial Sequence: Synthetic oligonucleotide"
gguuucaugccaauaauuu

SEQ ID NO: 5496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuucaugccaauaauuutt

SEQ ID NO: 5497 - RNA, 19 nt, Artificial Sequence
  source: /note="Description of Artificial Sequence: Synthetic oligonucleotide"
aauuauuggcaugaaaccc

SEQ ID NO: 5498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuauuggcaugaaaccctt

SEQ ID NO: 5499 - RNA, 19 nt, Artificial Sequence
  source: /note="Description of Artificial Sequence: Synthetic oligonucleotide"
ggguuucaugccaauaauu

SEQ ID NO: 5500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguuucaugccaauaauutt

SEQ ID NO: 5501 - RNA, 19 nt, Artificial Sequence
  source: /note="Description of Artificial Sequence: Synthetic oligonucleotide"
uuauuggcaugaaacccuu

SEQ ID NO: 5502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauuggcaugaaacccuutt

SEQ ID NO: 5503 - RNA, 19 nt, Artificial Sequence
  source: /note="Description of Artificial Sequence: Synthetic oligonucleotide"
aaggguuucaugccaauaa

SEQ ID NO: 5504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggguuucaugccaauaatt

SEQ ID NO: 5505 - RNA, 19 nt, Artificial Sequence
  source: /note="Description of Artificial Sequence: Synthetic oligonucleotide"
caucucccggcgugccccg

SEQ ID NO: 5506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucucccggcgugccccgtt

SEQ ID NO: 5507 - RNA, 19 nt, Artificial Sequence
  source: /note="Description of Artificial Sequence: Synthetic oligonucleotide"
cggggcacgccgggagaug

SEQ ID NO: 5508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggcacgccgggagaugtt

SEQ ID NO: 5509 - RNA, 19 nt, Artificial Sequence
  source: /note="Description of Artificial Sequence: Synthetic oligonucleotide"
aucucccggcgugccccgc

SEQ ID NO: 5510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucucccggcgugccccgctt

SEQ ID NO: 5511 - RNA, 19 nt, Artificial Sequence
  source: /note="Description of Artificial Sequence: Synthetic oligonucleotide"
gcggggcacgccgggagau

SEQ ID NO: 5512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggggcacgccgggagautt

SEQ ID NO: 5513 - RNA, 19 nt, Artificial Sequence
  source: /note="Description of Artificial Sequence: Synthetic oligonucleotide"
gaagaggccggagcccagg

SEQ ID NO: 5514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaggccggagcccaggtt

SEQ ID NO: 5515 - RNA, 19 nt, Artificial Sequence
  source: /note="Description of Artificial Sequence: Synthetic oligonucleotide"
ccugggcuccggccucuuc

SEQ ID NO: 5516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggcuccggccucuuctt

SEQ ID NO: 5517 - RNA, 19 nt, Artificial Sequence
  source: /note="Description of Artificial Sequence: Synthetic oligonucleotide"
ccccgcggccugggccugc

SEQ ID NO: 5518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgcggccugggccugctt

SEQ ID NO: 5519 - RNA, 19 nt, Artificial Sequence
  source: /note="Description of Artificial Sequence: Synthetic oligonucleotide"
gcaggcccaggccgcgggg

SEQ ID NO: 5520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaggcccaggccgcggggtt

SEQ ID NO: 5521 - RNA, 19 nt, Artificial Sequence
  source: /note="Description of Artificial Sequence: Synthetic oligonucleotide"
cccgcggccugggccugcg

SEQ ID NO: 5522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgcggccugggccugcgtt

SEQ ID NO: 5523 - RNA, 19 nt, Artificial Sequence
  source: /note="Description of Artificial Sequence: Synthetic oligonucleotide"
cgcaggcccaggccgcggg

SEQ ID NO: 5524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcaggcccaggccgcgggtt

SEQ ID NO: 5525 - RNA, 19 nt, Artificial Sequence
  source: /note="Description of Artificial Sequence: Synthetic oligonucleotide"
ggcucgggccgggcgcgga

SEQ ID NO: 5526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucgggccgggcgcggatt

SEQ ID NO: 5527 - RNA, 19 nt, Artificial Sequence
  source: /note="Description of Artificial Sequence: Synthetic oligonucleotide"
uccgcgcccggcccgagcc

SEQ ID NO: 5528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgcgcccggcccgagcctt

SEQ ID NO: 5529 - RNA, 19 nt, Artificial Sequence
  source: /note="Description of Artificial Sequence: Synthetic oligonucleotide"
gccgggcgcggaccagcuc

SEQ ID NO: 5530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgggcgcggaccagcuctt

SEQ ID NO: 5531 - RNA, 19 nt, Artificial Sequence
  source: /note="Description of Artificial Sequence: Synthetic oligonucleotide"
gagcugguccgcgcccggc

SEQ ID NO: 5532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcugguccgcgcccggctt

SEQ ID NO: 5533 - RNA, 19 nt, Artificial Sequence
  source: /note="Description of Artificial Sequence: Synthetic oligonucleotide"
ccagcucguucgcggagcc

SEQ ID NO: 5534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcucguucgcggagcctt

SEQ ID NO: 5535 - RNA, 19 nt, Artificial Sequence
  source: /note="Description of Artificial Sequence: Synthetic oligonucleotide"
ggcuccgcgaacgagcugg

SEQ ID NO: 5536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccgcgaacgagcuggtt

SEQ ID NO: 5537 - RNA, 19 nt, Artificial Sequence
  source: /note="Description of Artificial Sequence: Synthetic oligonucleotide"
agccaggaggcggaggcgg

SEQ ID NO: 5538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccaggaggcggaggcggtt

SEQ ID NO: 5539 - RNA, 19 nt, Artificial Sequence
  source: /note="Description of Artificial Sequence: Synthetic oligonucleotide"
ccgccuccgccuccuggcu

SEQ ID NO: 5540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccuccgccuccuggcutt

SEQ ID NO: 5541 - RNA, 19 nt, Artificial Sequence
  source: /note="Description of Artificial Sequence: Synthetic oligonucleotide"
ggggcucggccucuggccc

SEQ ID NO: 5542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcucggccucuggccctt

SEQ ID NO: 5543 - RNA, 19 nt, Artificial Sequence
  source: /note="Description of Artificial Sequence: Synthetic oligonucleotide"
gggccagaggccgagcccc

SEQ ID NO: 5544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccagaggccgagcccctt

SEQ ID NO: 5545 - RNA, 19 nt, Artificial Sequence
  source: /note="Description of Artificial Sequence: Synthetic oligonucleotide"
ggccccagcggcagcggcg

SEQ ID NO: 5546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccagcggcagcggcgtt

SEQ ID NO: 5547 - RNA, 19 nt, Artificial Sequence
  source: /note="Description of Artificial Sequence: Synthetic oligonucleotide"
cgccgcugccgcuggggcc

SEQ ID NO: 5548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgcugccgcuggggcctt

SEQ ID NO: 5549 - RNA, 19 nt, Artificial Sequence
  source: /note="Description of Artificial Sequence: Synthetic oligonucleotide"
gcagcggcggaggaggcag

SEQ ID NO: 5550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcggcggaggaggcagtt

SEQ ID NO: 5551 - RNA, 19 nt, Artificial Sequence
  source: /note="Description of Artificial Sequence: Synthetic oligonucleotide"
cugccuccuccgccgcugc

SEQ ID NO: 5552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccuccuccgccgcugctt

SEQ ID NO: 5553 - RNA, 19 nt, Artificial Sequence
  source: /note="Description of Artificial Sequence: Synthetic oligonucleotide"
agcgguggccccggcgcgg

SEQ ID NO: 5554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgguggccccggcgcggtt

SEQ ID NO: 5555 - RNA, 19 nt, Artificial Sequence
  source: /note="Description of Artificial Sequence: Synthetic oligonucleotide"
ccgcgccggggccaccgcu

SEQ ID NO: 5556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcgccggggccaccgcutt

SEQ ID NO: 5557 - RNA, 19 nt, Artificial Sequence
  source: /note="Description of Artificial Sequence: Synthetic oligonucleotide"
uagccacuguaggccaagg

SEQ ID NO: 5558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccacuguaggccaaggtt

SEQ ID NO: 5559 - RNA, 19 nt, Artificial Sequence
  source: /note="Description of Artificial Sequence: Synthetic oligonucleotide"
ccuuggccuacaguggcua

SEQ ID NO: 5560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuggccuacaguggcuatt

SEQ ID NO: 5561 - RNA, 19 nt, Artificial Sequence
  source: /note="Description of Artificial Sequence: Synthetic oligonucleotide"
ucccaagaaguggcuuaca

SEQ ID NO: 5562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccaagaaguggcuuacatt

SEQ ID NO: 5563 - RNA, 19 nt, Artificial Sequence
  source: /note="Description of Artificial Sequence: Synthetic oligonucleotide"
uguaagccacuucuuggga

SEQ ID NO: 5564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaagccacuucuugggatt

SEQ ID NO: 5565 - RNA, 19 nt, Artificial Sequence
  source: /note="Description of Artificial Sequence: Synthetic oligonucleotide"
ccgagaacugcagauuaug

SEQ ID NO: 5566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagaacugcagauuaugtt

SEQ ID NO: 5567 - RNA, 19 nt, Artificial Sequence
  source: /note="Description of Artificial Sequence: Synthetic oligonucleotide"
cauaaucugcaguucucgg

SEQ ID NO: 5568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauaaucugcaguucucggtt

SEQ ID NO: 5569 - RNA, 19 nt, Artificial Sequence
  source: /note="Description of Artificial Sequence: Synthetic oligonucleotide"
cuucccuggggacaguggg

SEQ ID NO: 5570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccuggggacagugggtt

SEQ ID NO: 5571 - RNA, 19 nt, Artificial Sequence
  source: /note="Description of Artificial Sequence: Synthetic oligonucleotide"
cccacuguccccagggaag

SEQ ID NO: 5572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacuguccccagggaagtt

SEQ ID NO: 5573 - RNA, 19 nt, Artificial Sequence
  source: /note="Description of Artificial Sequence: Synthetic oligonucleotide"
ccauccucaaggcucuccc

SEQ ID NO: 5574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauccucaaggcucuccctt

SEQ ID NO: 5575 - RNA, 19 nt, Artificial Sequence
  source: /note="Description of Artificial Sequence: Synthetic oligonucleotide"
gggagagccuugaggaugg

SEQ ID NO: 5576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagagccuugaggauggtt

SEQ ID NO: 5577 - RNA, 19 nt, Artificial Sequence
  source: /note="Description of Artificial Sequence: Synthetic oligonucleotide"
auccucaaggcucucccca

SEQ ID NO: 5578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccucaaggcucuccccatt

SEQ ID NO: 5579 - RNA, 19 nt, Artificial Sequence
  source: /note="Description of Artificial Sequence: Synthetic oligonucleotide"
uggggagagccuugaggau

SEQ ID NO: 5580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggagagccuugaggautt

SEQ ID NO: 5581 - RNA, 19 nt, Artificial Sequence
  source: /note="Description of Artificial Sequence: Synthetic oligonucleotide"
uccauccaaccaucucuca

SEQ ID NO: 5582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccauccaaccaucucucatt

SEQ ID NO: 5583 - RNA, 19 nt, Artificial Sequence
  source: /note="Description of Artificial Sequence: Synthetic oligonucleotide"
ugagagaugguuggaugga

SEQ ID NO: 5584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagagaugguuggauggatt

SEQ ID NO: 5585 - RNA, 19 nt, Artificial Sequence
  source: /note="Description of Artificial Sequence: Synthetic oligonucleotide"
cagccaucugaugccacaa

SEQ ID NO: 5586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccaucugaugccacaatt

SEQ ID NO: 5587 - RNA, 19 nt, Artificial Sequence
  source: /note="Description of Artificial Sequence: Synthetic oligonucleotide"
uuguggcaucagauggcug

SEQ ID NO: 5588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguggcaucagauggcugtt

SEQ ID NO: 5589 - RNA, 19 nt, Artificial Sequence
  source: /note="Description of Artificial Sequence: Synthetic oligonucleotide"
ucagcagccuaaccucugu

SEQ ID NO: 5590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagcagccuaaccucugutt

SEQ ID NO: 5591 - RNA, 19 nt, Artificial Sequence
  source: /note="Description of Artificial Sequence: Synthetic oligonucleotide"
acagagguuaggcugcuga

SEQ ID NO: 5592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagagguuaggcugcugatt

SEQ ID NO: 5593 - RNA, 19 nt, Artificial Sequence
  source: /note="Description of Artificial Sequence: Synthetic oligonucleotide"
cuucccucccccccucucc

SEQ ID NO: 5594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccucccccccucucctt

SEQ ID NO: 5595 - RNA, 19 nt, Artificial Sequence
  source: /note="Description of Artificial Sequence: Synthetic oligonucleotide"
ggagagggggggagggaag

SEQ ID NO: 5596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagagggggggagggaagtt

SEQ ID NO: 5597 - RNA, 19 nt, Artificial Sequence
  source: /note="Description of Artificial Sequence: Synthetic oligonucleotide"
cccucccccccucucccag

SEQ ID NO: 5598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucccccccucucccagtt

SEQ ID NO: 5599 - RNA, 19 nt, Artificial Sequence
  source: /note="Description of Artificial Sequence: Synthetic oligonucleotide"
cugggagagggggggaggg

SEQ ID NO: 5600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggagagggggggagggtt

SEQ ID NO: 5601 - RNA, 19 nt, Artificial Sequence
  source: /note="Description of Artificial Sequence: Synthetic oligonucleotide"
ccagcuguaccccuucuug

SEQ ID NO: 5602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcuguaccccuucuugtt

SEQ ID NO: 5603 - RNA, 19 nt, Artificial Sequence
  source: /note="Description of Artificial Sequence: Synthetic oligonucleotide"
caagaagggguacagcugg

SEQ ID NO: 5604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagaagggguacagcuggtt

SEQ ID NO: 5605 - RNA, 19 nt, Artificial Sequence
  source: /note="Description of Artificial Sequence: Synthetic oligonucleotide"
uuguccucugcucccaagg

SEQ ID NO: 5606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccucugcucccaaggtt

SEQ ID NO: 5607 - RNA, 19 nt, Artificial Sequence
  source: /note="Description of Artificial Sequence: Synthetic oligonucleotide"
ccuugggagcagaggacaa

SEQ ID NO: 5608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugggagcagaggacaatt

SEQ ID NO: 5609 - RNA, 19 nt, Artificial Sequence
  source: /note="Description of Artificial Sequence: Synthetic oligonucleotide"
uccucugcucccaaggcuu

SEQ ID NO: 5610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucugcucccaaggcuutt

SEQ ID NO: 5611 - RNA, 19 nt, Artificial Sequence
  source: /note="Description of Artificial Sequence: Synthetic oligonucleotide"
aagccuugggagcagagga

SEQ ID NO: 5612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccuugggagcagaggatt

SEQ ID NO: 5613 - RNA, 19 nt, Artificial Sequence
  source: /note="Description of Artificial Sequence: Synthetic oligonucleotide"
ucugcucccaaggcuuccu

SEQ ID NO: 5614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcucccaaggcuuccutt

SEQ ID NO: 5615 - RNA, 19 nt, Artificial Sequence
  source: /note="Description of Artificial Sequence: Synthetic oligonucleotide"
aggaagccuugggagcaga

SEQ ID NO: 5616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaagccuugggagcagatt

SEQ ID NO: 5617 - RNA, 19 nt, Artificial Sequence
  source: /note="Description of Artificial Sequence: Synthetic oligonucleotide"
auccuggaaggaggggagu

SEQ ID NO: 5618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccuggaaggaggggagutt

SEQ ID NO: 5619 - RNA, 19 nt, Artificial Sequence
  source: /note="Description of Artificial Sequence: Synthetic oligonucleotide"
acuccccuccuuccaggau

SEQ ID NO: 5620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccccuccuuccaggautt

SEQ ID NO: 5621 - RNA, 19 nt, Artificial Sequence
  source: /note="Description of Artificial Sequence: Synthetic oligonucleotide"
ucaucucccggcgugcccc

SEQ ID NO: 5622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucucccggcgugcccctt

SEQ ID NO: 5623 - RNA, 19 nt, Artificial Sequence
  source: /note="Description of Artificial Sequence: Synthetic oligonucleotide"
ggggcacgccgggagauga

SEQ ID NO: 5624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcacgccgggagaugatt

SEQ ID NO: 5625 - RNA, 19 nt, Artificial Sequence
  source: /note="Description of Artificial Sequence: Synthetic oligonucleotide"
ugccccgcggcgggcgcug

SEQ ID NO: 5626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccccgcggcgggcgcugtt

SEQ ID NO: 5627 - RNA, 19 nt, Artificial Sequence
  source: /note="Description of Artificial Sequence: Synthetic oligonucleotide"
cagcgcccgccgcggggca

SEQ ID NO: 5628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcgcccgccgcggggcatt

SEQ ID NO: 5629 - RNA, 19 nt, Artificial Sequence
  source: /note="Description of Artificial Sequence: Synthetic oligonucleotide"
gccccgcggcgggcgcugg

SEQ ID NO: 5630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccgcggcgggcgcuggtt

SEQ ID NO: 5631 - RNA, 19 nt, Artificial Sequence
  source: /note="Description of Artificial Sequence: Synthetic oligonucleotide"
ccagcgcccgccgcggggc

SEQ ID NO: 5632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcgcccgccgcggggctt

SEQ ID NO: 5633 - RNA, 19 nt, Artificial Sequence
  source: /note="Description of Artificial Sequence: Synthetic oligonucleotide"
cggcgggcgcugggccgga

SEQ ID NO: 5634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcgggcgcugggccggatt

SEQ ID NO: 5635 - RNA, 19 nt, Artificial Sequence
  source: /note="Description of Artificial Sequence: Synthetic oligonucleotide"
uccggcccagcgcccgccg

SEQ ID NO: 5636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggcccagcgcccgccgtt

SEQ ID NO: 5637 - RNA, 19 nt, Artificial Sequence
  source: /note="Description of Artificial Sequence: Synthetic oligonucleotide"
ggcgggcgcugggccggag

SEQ ID NO: 5638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgggcgcugggccggagtt

SEQ ID NO: 5639 - RNA, 19 nt, Artificial Sequence
  source: /note="Description of Artificial Sequence: Synthetic oligonucleotide"
cuccggcccagcgcccgcc

SEQ ID NO: 5640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggcccagcgcccgcctt

SEQ ID NO: 5641 - RNA, 19 nt, Artificial Sequence
  source: /note="Description of Artificial Sequence: Synthetic oligonucleotide"
gcgggcgcugggccggagc

SEQ ID NO: 5642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggcgcugggccggagctt

SEQ ID NO: 5643 - RNA, 19 nt, Artificial Sequence
  source: /note="Description of Artificial Sequence: Synthetic oligonucleotide"
gcuccggcccagcgcccgc

SEQ ID NO: 5644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccggcccagcgcccgctt

SEQ ID NO: 5645 - RNA, 19 nt, Artificial Sequence
  source: /note="Description of Artificial Sequence: Synthetic oligonucleotide"
gcugggccggagccggagc

SEQ ID NO: 5646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggccggagccggagctt

SEQ ID NO: 5647 - RNA, 19 nt, Artificial Sequence
  source: /note="Description of Artificial Sequence: Synthetic oligonucleotide"
gcuccggcuccggcccagc

SEQ ID NO: 5648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccggcuccggcccagctt

SEQ ID NO: 5649 - RNA, 19 nt, Artificial Sequence
  source: /note="Description of Artificial Sequence: Synthetic oligonucleotide"
gggccggagccggagcccg

SEQ ID NO: 5650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccggagccggagcccgtt

SEQ ID NO: 5651 - RNA, 19 nt, Artificial Sequence
  source: /note="Description of Artificial Sequence: Synthetic oligonucleotide"
cgggcuccggcuccggccc

SEQ ID NO: 5652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcuccggcuccggccctt

SEQ ID NO: 5653 - RNA, 19 nt, Artificial Sequence
  source: /note="Description of Artificial Sequence: Synthetic oligonucleotide"
ccggagccggagcccgaac

SEQ ID NO: 5654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagccggagcccgaactt

SEQ ID NO: 5655 - RNA, 19 nt, Artificial Sequence
  source: /note="Description of Artificial Sequence: Synthetic oligonucleotide"
guucgggcuccggcuccgg

SEQ ID NO: 5656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucgggcuccggcuccggtt

SEQ ID NO: 5657 - RNA, 19 nt, Artificial Sequence
  source: /note="Description of Artificial Sequence: Synthetic oligonucleotide"
gccuggaagaggccggagc

SEQ ID NO: 5658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuggaagaggccggagctt

SEQ ID NO: 5659 - RNA, 19 nt, Artificial Sequence
  source: /note="Description of Artificial Sequence: Synthetic oligonucleotide"
gcuccggccucuuccaggc

SEQ ID NO: 5660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccggccucuuccaggctt

SEQ ID NO: 5661 - RNA, 19 nt, Artificial Sequence
  source: /note="Description of Artificial Sequence: Synthetic oligonucleotide"
ccuggaagaggccggagcc

SEQ ID NO: 5662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggaagaggccggagcctt

SEQ ID NO: 5663 - RNA, 19 nt, Artificial Sequence
  source: /note="Description of Artificial Sequence: Synthetic oligonucleotide"
ggcuccggccucuuccagg

SEQ ID NO: 5664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccggccucuuccaggtt

SEQ ID NO: 5665 - RNA, 19 nt, Artificial Sequence
  source: /note="Description of Artificial Sequence: Synthetic oligonucleotide"
aggccggagcccaggggag

SEQ ID NO: 5666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccggagcccaggggagtt

SEQ ID NO: 5667 - RNA, 19 nt, Artificial Sequence
  source: /note="Description of Artificial Sequence: Synthetic oligonucleotide"
cuccccugggcuccggccu

SEQ ID NO: 5668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccugggcuccggccutt

SEQ ID NO: 5669 - RNA, 19 nt, Artificial Sequence
  source: /note="Description of Artificial Sequence: Synthetic oligonucleotide"
ggccggagcccaggggagg

SEQ ID NO: 5670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccggagcccaggggaggtt

SEQ ID NO: 5671 - RNA, 19 nt, Artificial Sequence
  source: /note="Description of Artificial Sequence: Synthetic oligonucleotide"
ccuccccugggcuccggcc

SEQ ID NO: 5672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccccugggcuccggcctt

SEQ ID NO: 5673 - RNA, 19 nt, Artificial Sequence
  source: /note="Description of Artificial Sequence: Synthetic oligonucleotide"
ggagcccaggggaggcggc

SEQ ID NO: 5674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcccaggggaggcggctt

SEQ ID NO: 5675 - RNA, 19 nt, Artificial Sequence
  source: /note="Description of Artificial Sequence: Synthetic oligonucleotide"
gccgccuccccugggcucc

SEQ ID NO: 5676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccuccccugggcucctt

SEQ ID NO: 5677 - RNA, 19 nt, Artificial Sequence
  source: /note="Description of Artificial Sequence: Synthetic oligonucleotide"
cccaggggaggcggcggca

SEQ ID NO: 5678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggggaggcggcggcatt

SEQ ID NO: 5679 - RNA, 19 nt, Artificial Sequence
  source: /note="Description of Artificial Sequence: Synthetic oligonucleotide"
ugccgccgccuccccuggg

SEQ ID NO: 5680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccgccgccuccccugggtt

SEQ ID NO: 5681 - RNA, 19 nt, Artificial Sequence
  source: /note="Description of Artificial Sequence: Synthetic oligonucleotide"
ccaggggaggcggcggcag

SEQ ID NO: 5682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggggaggcggcggcagtt

SEQ ID NO: 5683 - RNA, 19 nt, Artificial Sequence
  source: /note="Description of Artificial Sequence: Synthetic oligonucleotide"
cugccgccgccuccccugg

SEQ ID NO: 5684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccgccgccuccccuggtt

SEQ ID NO: 5685 - RNA, 19 nt, Artificial Sequence
  source: /note="Description of Artificial Sequence: Synthetic oligonucleotide"
ggcggcagaggcagcggcg

SEQ ID NO: 5686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcagaggcagcggcgtt

SEQ ID NO: 5687 - RNA, 19 nt, Artificial Sequence
  source: /note="Description of Artificial Sequence: Synthetic oligonucleotide"
cgccgcugccucugccgcc

SEQ ID NO: 5688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgcugccucugccgcctt

SEQ ID NO: 5689 - RNA, 19 nt, Artificial Sequence
  source: /note="Description of Artificial Sequence: Synthetic oligonucleotide"
gcggcagaggcagcggcgg

SEQ ID NO: 5690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcagaggcagcggcggtt

SEQ ID NO: 5691 - RNA, 19 nt, Artificial Sequence
  source: /note="Description of Artificial Sequence: Synthetic oligonucleotide"
ccgccgcugccucugccgc

SEQ ID NO: 5692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgcugccucugccgctt

SEQ ID NO: 5693 - RNA, 19 nt, Artificial Sequence
  source: /note="Description of Artificial Sequence: Synthetic oligonucleotide"
cggcagaggcagcggcggg

SEQ ID NO: 5694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcagaggcagcggcgggtt

SEQ ID NO: 5695 - RNA, 19 nt, Artificial Sequence
  source: /note="Description of Artificial Sequence: Synthetic oligonucleotide"
cccgccgcugccucugccg

SEQ ID NO: 5696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccgcugccucugccgtt

SEQ ID NO: 5697 - RNA, 19 nt, Artificial Sequence
  source: /note="Description of Artificial Sequence: Synthetic oligonucleotide"
ggcagaggcagcggcgggg

SEQ ID NO: 5698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagaggcagcggcggggtt

SEQ ID NO: 5699 - RNA, 19 nt, Artificial Sequence
  source: /note="Description of Artificial Sequence: Synthetic oligonucleotide"
ccccgccgcugccucugcc

SEQ ID NO: 5700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgccgcugccucugcctt

SEQ ID NO: 5701 - RNA, 19 nt, Artificial Sequence
  source: /note="Description of Artificial Sequence: Synthetic oligonucleotide"
gcagcggcgggggcagccc

SEQ ID NO: 5702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcggcgggggcagccctt

SEQ ID NO: 5703 - RNA, 19 nt, Artificial Sequence
  source: /note="Description of Artificial Sequence: Synthetic oligonucleotide"
gggcugcccccgccgcugc

SEQ ID NO: 5704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcugcccccgccgcugctt

SEQ ID NO: 5705 - RNA, 19 nt, Artificial Sequence
  source: /note="Description of Artificial Sequence: Synthetic oligonucleotide"
cgggggcagcccaggcagc

SEQ ID NO: 5706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggggcagcccaggcagctt

SEQ ID NO: 5707 - RNA, 19 nt, Artificial Sequence
  source: /note="Description of Artificial Sequence: Synthetic oligonucleotide"
gcugccugggcugcccccg

SEQ ID NO: 5708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccugggcugcccccgtt

SEQ ID NO: 5709 - RNA, 19 nt, Artificial Sequence
  source: /note="Description of Artificial Sequence: Synthetic oligonucleotide"
ggcagcccaggcagcccga

SEQ ID NO: 5710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcccaggcagcccgatt

SEQ ID NO: 5711 - RNA, 19 nt, Artificial Sequence
  source: /note="Description of Artificial Sequence: Synthetic oligonucleotide"
ucgggcugccugggcugcc

SEQ ID NO: 5712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgggcugccugggcugcctt

SEQ ID NO: 5713 - RNA, 19 nt, Artificial Sequence
  source: /note="Description of Artificial Sequence: Synthetic oligonucleotide"
agcccaggcagcccgagcc

SEQ ID NO: 5714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaggcagcccgagcctt

SEQ ID NO: 5715 - RNA, 19 nt, Artificial Sequence
  source: /note="Description of Artificial Sequence: Synthetic oligonucleotide"
ggcucgggcugccugggcu

SEQ ID NO: 5716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucgggcugccugggcutt

SEQ ID NO: 5717 - RNA, 19 nt, Artificial Sequence
  source: /note="Description of Artificial Sequence: Synthetic oligonucleotide"
ggcagcccgagccccgcgg

SEQ ID NO: 5718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcccgagccccgcggtt

SEQ ID NO: 5719 - RNA, 19 nt, Artificial Sequence
  source: /note="Description of Artificial Sequence: Synthetic oligonucleotide"
ccgcggggcucgggcugcc

SEQ ID NO: 5720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcggggcucgggcugcctt

SEQ ID NO: 5721 - RNA, 19 nt, Artificial Sequence
  source: /note="Description of Artificial Sequence: Synthetic oligonucleotide"
cagcccgagccccgcggcc

SEQ ID NO: 5722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccgagccccgcggcctt

SEQ ID NO: 5723 - RNA, 19 nt, Artificial Sequence
  source: /note="Description of Artificial Sequence: Synthetic oligonucleotide"
ggccgcggggcucgggcug

SEQ ID NO: 5724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgcggggcucgggcugtt

SEQ ID NO: 5725 - RNA, 19 nt, Artificial Sequence
  source: /note="Description of Artificial Sequence: Synthetic oligonucleotide"
agcccgagccccgcggccu

SEQ ID NO: 5726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccgagccccgcggccutt

SEQ ID NO: 5727 - RNA, 19 nt, Artificial Sequence
  source: /note="Description of Artificial Sequence: Synthetic oligonucleotide"
aggccgcggggcucgggcu

SEQ ID NO: 5728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccgcggggcucgggcutt

SEQ ID NO: 5729 - RNA, 19 nt, Artificial Sequence
  source: /note="Description of Artificial Sequence: Synthetic oligonucleotide"
gcccgagccccgcggccug

SEQ ID NO: 5730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgagccccgcggccugtt

SEQ ID NO: 5731 - RNA, 19 nt, Artificial Sequence
  source: /note="Description of Artificial Sequence: Synthetic oligonucleotide"
caggccgcggggcucgggc

SEQ ID NO: 5732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggccgcggggcucgggctt

SEQ ID NO: 5733 - RNA, 19 nt, Artificial Sequence
  source: /note="Description of Artificial Sequence: Synthetic oligonucleotide"
cgagccccgcggccugggc

SEQ ID NO: 5734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagccccgcggccugggctt

SEQ ID NO: 5735 - RNA, 19 nt, Artificial Sequence
  source: /note="Description of Artificial Sequence: Synthetic oligonucleotide"
gcccaggccgcggggcucg

SEQ ID NO: 5736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaggccgcggggcucgtt

SEQ ID NO: 5737 - RNA, 19 nt, Artificial Sequence
  source: /note="Description of Artificial Sequence: Synthetic oligonucleotide"
gagccccgcggccugggcc

SEQ ID NO: 5738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccccgcggccugggcctt

SEQ ID NO: 5739 - RNA, 19 nt, Artificial Sequence
  source: /note="Description of Artificial Sequence: Synthetic oligonucleotide"
ggcccaggccgcggggcuc

SEQ ID NO: 5740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccaggccgcggggcuctt

SEQ ID NO: 5741 - RNA, 19 nt, Artificial Sequence
  source: /note="Description of Artificial Sequence: Synthetic oligonucleotide"
agccccgcggccugggccu

SEQ ID NO: 5742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccccgcggccugggccutt

SEQ ID NO: 5743 - RNA, 19 nt, Artificial Sequence
  source: /note="Description of Artificial Sequence: Synthetic oligonucleotide"
aggcccaggccgcggggcu

SEQ ID NO: 5744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcccaggccgcggggcutt

SEQ ID NO: 5745 - RNA, 19 nt, Artificial Sequence
  source: /note="Description of Artificial Sequence: Synthetic oligonucleotide"
gccccgcggccugggccug

SEQ ID NO: 5746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccgcggccugggccugtt

SEQ ID NO: 5747 - RNA, 19 nt, Artificial Sequence
  source: /note="Description of Artificial Sequence: Synthetic oligonucleotide"
caggcccaggccgcggggc

SEQ ID NO: 5748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcccaggccgcggggctt

SEQ ID NO: 5749 - RNA, 19 nt, Artificial Sequence
  source: /note="Description of Artificial Sequence: Synthetic oligonucleotide"
gggccugcgcucggcgcca

SEQ ID NO: 5750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccugcgcucggcgccatt

SEQ ID NO: 5751 - RNA, 19 nt, Artificial Sequence
  source: /note="Description of Artificial Sequence: Synthetic oligonucleotide"
uggcgccgagcgcaggccc

SEQ ID NO: 5752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcgccgagcgcaggccctt

SEQ ID NO: 5753 - RNA, 19 nt, Artificial Sequence
  source: /note="Description of Artificial Sequence: Synthetic oligonucleotide"
ucgggaggcggcccugggg

SEQ ID NO: 5754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgggaggcggcccuggggtt

SEQ ID NO: 5755 - RNA, 19 nt, Artificial Sequence
  source: /note="Description of Artificial Sequence: Synthetic oligonucleotide"
ccccagggccgccucccga

SEQ ID NO: 5756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagggccgccucccgatt

SEQ ID NO: 5757 - RNA, 19 nt, Artificial Sequence
  source: /note="Description of Artificial Sequence: Synthetic oligonucleotide"
cgggaggcggcccuggggg

SEQ ID NO: 5758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggaggcggcccugggggtt

SEQ ID NO: 5759 - RNA, 19 nt, Artificial Sequence
  source: /note="Description of Artificial Sequence: Synthetic oligonucleotide"
cccccagggccgccucccg

SEQ ID NO: 5760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccagggccgccucccgtt

SEQ ID NO: 5761 - RNA, 19 nt, Artificial Sequence
  source: /note="Description of Artificial Sequence: Synthetic oligonucleotide"
gggaggcggcccugggggc

SEQ ID NO: 5762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggcggcccugggggctt

SEQ ID NO: 5763 - RNA, 19 nt, Artificial Sequence
  source: /note="Description of Artificial Sequence: Synthetic oligonucleotide"
gcccccagggccgccuccc

SEQ ID NO: 5764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccagggccgccuccctt

SEQ ID NO: 5765 - RNA, 19 nt, Artificial Sequence
  source: /note="Description of Artificial Sequence: Synthetic oligonucleotide"
gcggcccugggggcucggg

SEQ ID NO: 5766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcccugggggcucgggtt

SEQ ID NO: 5767 - RNA, 19 nt, Artificial Sequence
  source: /note="Description of Artificial Sequence: Synthetic oligonucleotide"
cccgagcccccagggccgc

SEQ ID NO: 5768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgagcccccagggccgctt

SEQ ID NO: 5769 - RNA, 19 nt, Artificial Sequence
  source: /note="Description of Artificial Sequence: Synthetic oligonucleotide"
cggcccugggggcucgggc

SEQ ID NO: 5770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcccugggggcucgggctt

SEQ ID NO: 5771 - RNA, 19 nt, Artificial Sequence
  source: /note="Description of Artificial Sequence: Synthetic oligonucleotide"
gcccgagcccccagggccg

SEQ ID NO: 5772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgagcccccagggccgtt

SEQ ID NO: 5773 - RNA, 19 nt, Artificial Sequence
  source: /note="Description of Artificial Sequence: Synthetic oligonucleotide"
gggggcucgggccgggcgc

SEQ ID NO: 5774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggcucgggccgggcgctt

SEQ ID NO: 5775 - RNA, 19 nt, Artificial Sequence
  source: /note="Description of Artificial Sequence: Synthetic oligonucleotide"
gcgcccggcccgagccccc

SEQ ID NO: 5776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcccggcccgagccccctt

SEQ ID NO: 5777 - RNA, 19 nt, Artificial Sequence
  source: /note="Description of Artificial Sequence: Synthetic oligonucleotide"
ggggcucgggccgggcgcg

SEQ ID NO: 5778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcucgggccgggcgcgtt

SEQ ID NO: 5779 - RNA, 19 nt, Artificial Sequence
  source: /note="Description of Artificial Sequence: Synthetic oligonucleotide"
cgcgcccggcccgagcccc

SEQ ID NO: 5780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcgcccggcccgagcccctt

SEQ ID NO: 5781 - RNA, 19 nt, Artificial Sequence
  source: /note="Description of Artificial Sequence: Synthetic oligonucleotide"
cgggccgggcgcggaccag

SEQ ID NO: 5782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggccgggcgcggaccagtt

SEQ ID NO: 5783 - RNA, 19 nt, Artificial Sequence
  source: /note="Description of Artificial Sequence: Synthetic oligonucleotide"
cugguccgcgcccggcccg

SEQ ID NO: 5784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguccgcgcccggcccgtt

SEQ ID NO: 5785 - RNA, 19 nt, Artificial Sequence
  source: /note="Description of Artificial Sequence: Synthetic oligonucleotide"
ggagccaggaggcggaggc

SEQ ID NO: 5786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagccaggaggcggaggctt

SEQ ID NO: 5787 - RNA, 19 nt, Artificial Sequence
  source: /note="Description of Artificial Sequence: Synthetic oligonucleotide"
gccuccgccuccuggcucc

SEQ ID NO: 5788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuccgccuccuggcucctt

SEQ ID NO: 5789 - RNA, 19 nt, Artificial Sequence
  source: /note="Description of Artificial Sequence: Synthetic oligonucleotide"
gccaggaggcggaggcgga

SEQ ID NO: 5790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaggaggcggaggcggatt

SEQ ID NO: 5791 - RNA, 19 nt, Artificial Sequence
  source: /note="Description of Artificial Sequence: Synthetic oligonucleotide"
uccgccuccgccuccuggc

SEQ ID NO: 5792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgccuccgccuccuggctt

SEQ ID NO: 5793 - RNA, 19 nt, Artificial Sequence
  source: /note="Description of Artificial Sequence: Synthetic oligonucleotide"
ccaggaggcggaggcggag

SEQ ID NO: 5794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggaggcggaggcggagtt

SEQ ID NO: 5795 - RNA, 19 nt, Artificial Sequence
  source: /note="Description of Artificial Sequence: Synthetic oligonucleotide"
cuccgccuccgccuccugg

SEQ ID NO: 5796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgccuccgccuccuggtt

SEQ ID NO: 5797 - RNA, 19 nt, Artificial Sequence
  source: /note="Description of Artificial Sequence: Synthetic oligonucleotide"
ggcggaggcggagguggug

SEQ ID NO: 5798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggaggcggagguggugtt

SEQ ID NO: 5799 - RNA, 19 nt, Artificial Sequence
  source: /note="Description of Artificial Sequence: Synthetic oligonucleotide"
caccaccuccgccuccgcc

SEQ ID NO: 5800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaccuccgccuccgcctt

SEQ ID NO: 5801 - RNA, 19 nt, Artificial Sequence
  source: /note="Description of Artificial Sequence: Synthetic oligonucleotide"
gaggugguggcggcggccc

SEQ ID NO: 5802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggugguggcggcggccctt

SEQ ID NO: 5803 - RNA, 19 nt, Artificial Sequence
  source: /note="Description of Artificial Sequence: Synthetic oligonucleotide"
gggccgccgccaccaccuc

SEQ ID NO: 5804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccgccgccaccaccuctt

SEQ ID NO: 5805 - RNA, 19 nt, Artificial Sequence
  source: /note="Description of Artificial Sequence: Synthetic oligonucleotide"
aggugguggcggcggcccc

SEQ ID NO: 5806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggugguggcggcggcccctt

SEQ ID NO: 5807 - RNA, 19 nt, Artificial Sequence
  source: /note="Description of Artificial Sequence: Synthetic oligonucleotide"
ggggccgccgccaccaccu

SEQ ID NO: 5808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccgccgccaccaccutt

SEQ ID NO: 5809 - RNA, 19 nt, Artificial Sequence
  source: /note="Description of Artificial Sequence: Synthetic oligonucleotide"
ggugguggcggcggccccg

SEQ ID NO: 5810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugguggcggcggccccgtt

SEQ ID NO: 5811 - RNA, 19 nt, Artificial Sequence
  source: /note="Description of Artificial Sequence: Synthetic oligonucleotide"
cggggccgccgccaccacc

SEQ ID NO: 5812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggccgccgccaccacctt

SEQ ID NO: 5813 - RNA, 19 nt, Artificial Sequence
  source: /note="Description of Artificial Sequence: Synthetic oligonucleotide"
gugguggcggcggccccgg

SEQ ID NO: 5814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguggcggcggccccggtt

SEQ ID NO: 5815 - RNA, 19 nt, Artificial Sequence
  source: /note="Description of Artificial Sequence: Synthetic oligonucleotide"
ccggggccgccgccaccac

SEQ ID NO: 5816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggggccgccgccaccactt

SEQ ID NO: 5817 - RNA, 19 nt, Artificial Sequence
  source: /note="Description of Artificial Sequence: Synthetic oligonucleotide"
gcggcggccccgggggcuc

SEQ ID NO: 5818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcggccccgggggcuctt

SEQ ID NO: 5819 - RNA, 19 nt, Artificial Sequence
  source: /note="Description of Artificial Sequence: Synthetic oligonucleotide"
gagcccccggggccgccgc

SEQ ID NO: 5820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccccggggccgccgctt

SEQ ID NO: 5821 - RNA, 19 nt, Artificial Sequence
  source: /note="Description of Artificial Sequence: Synthetic oligonucleotide"
ggcggccccgggggcucgg

SEQ ID NO: 5822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggccccgggggcucggtt

SEQ ID NO: 5823 - RNA, 19 nt, Artificial Sequence
  source: /note="Description of Artificial Sequence: Synthetic oligonucleotide"
ccgagcccccggggccgcc

SEQ ID NO: 5824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagcccccggggccgcctt

SEQ ID NO: 5825 - RNA, 19 nt, Artificial Sequence
  source: /note="Description of Artificial Sequence: Synthetic oligonucleotide"
ccccgggggcucggccucu

SEQ ID NO: 5826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgggggcucggccucutt

SEQ ID NO: 5827 - RNA, 19 nt, Artificial Sequence
  source: /note="Description of Artificial Sequence: Synthetic oligonucleotide"
agaggccgagcccccgggg

SEQ ID NO: 5828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggccgagcccccggggtt

SEQ ID NO: 5829 - RNA, 19 nt, Artificial Sequence
  source: /note="Description of Artificial Sequence: Synthetic oligonucleotide"
ggcucggccucuggcccag

SEQ ID NO: 5830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucggccucuggcccagtt

SEQ ID NO: 5831 - RNA, 19 nt, Artificial Sequence
  source: /note="Description of Artificial Sequence: Synthetic oligonucleotide"
cugggccagaggccgagcc

SEQ ID NO: 5832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccagaggccgagcctt

SEQ ID NO: 5833 - RNA, 19 nt, Artificial Sequence
  source: /note="Description of Artificial Sequence: Synthetic oligonucleotide"
aggaggcacuggcggcggg

SEQ ID NO: 5834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaggcacuggcggcgggtt

SEQ ID NO: 5835 - RNA, 19 nt, Artificial Sequence
  source: /note="Description of Artificial Sequence: Synthetic oligonucleotide"
cccgccgccagugccuccu

SEQ ID NO: 5836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccgccagugccuccutt

SEQ ID NO: 5837 - RNA, 19 nt, Artificial Sequence
  source: /note="Description of Artificial Sequence: Synthetic oligonucleotide"
gcuccggggguggccccag

SEQ ID NO: 5838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccggggguggccccagtt

SEQ ID NO: 5839 - RNA, 19 nt, Artificial Sequence
  source: /note="Description of Artificial Sequence: Synthetic oligonucleotide"
cuggggccacccccggagc

SEQ ID NO: 5840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggccacccccggagctt

SEQ ID NO: 5841 - RNA, 19 nt, Artificial Sequence
  source: /note="Description of Artificial Sequence: Synthetic oligonucleotide"
cuccggggguggccccagc

SEQ ID NO: 5842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggggguggccccagctt

SEQ ID NO: 5843 - RNA, 19 nt, Artificial Sequence
  source: /note="Description of Artificial Sequence: Synthetic oligonucleotide"
gcuggggccacccccggag

SEQ ID NO: 5844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggggccacccccggagtt

SEQ ID NO: 5845 - RNA, 19 nt, Artificial Sequence
  source: /note="Description of Artificial Sequence: Synthetic oligonucleotide"
ccccagcggcagcggcgga

SEQ ID NO: 5846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagcggcagcggcggatt

SEQ ID NO: 5847 - RNA, 19 nt, Artificial Sequence
  source: /note="Description of Artificial Sequence: Synthetic oligonucleotide"
uccgccgcugccgcugggg

SEQ ID NO: 5848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgccgcugccgcuggggtt

SEQ ID NO: 5849 - RNA, 19 nt, Artificial Sequence
  source: /note="Description of Artificial Sequence: Synthetic oligonucleotide"
cccagcggcagcggcggag

SEQ ID NO: 5850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcggcagcggcggagtt

SEQ ID NO: 5851 - RNA, 19 nt, Artificial Sequence
  source: /note="Description of Artificial Sequence: Synthetic oligonucleotide"
cuccgccgcugccgcuggg

SEQ ID NO: 5852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgccgcugccgcugggtt

SEQ ID NO: 5853 - RNA, 19 nt, Artificial Sequence
  source: /note="Description of Artificial Sequence: Synthetic oligonucleotide"
ccagcggcagcggcggagg

SEQ ID NO: 5854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcggcagcggcggaggtt

SEQ ID NO: 5855 - RNA, 19 nt, Artificial Sequence
  source: /note="Description of Artificial Sequence: Synthetic oligonucleotide"
ccuccgccgcugccgcugg

SEQ ID NO: 5856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccgccgcugccgcuggtt

SEQ ID NO: 5857 - RNA, 19 nt, Artificial Sequence
  source: /note="Description of Artificial Sequence: Synthetic oligonucleotide"
cagcggcagcggcggagga

SEQ ID NO: 5858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcggcagcggcggaggatt

SEQ ID NO: 5859 - RNA, 19 nt, Artificial Sequence
  source: /note="Description of Artificial Sequence: Synthetic oligonucleotide"
uccuccgccgcugccgcug

SEQ ID NO: 5860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuccgccgcugccgcugtt

SEQ ID NO: 5861 - RNA, 19 nt, Artificial Sequence
  source: /note="Description of Artificial Sequence: Synthetic oligonucleotide"
gcggcagcggcggaggagg

SEQ ID NO: 5862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcagcggcggaggaggtt

SEQ ID NO: 5863 - RNA, 19 nt, Artificial Sequence
  source: /note="Description of Artificial Sequence: Synthetic oligonucleotide"
ccuccuccgccgcugccgc

SEQ ID NO: 5864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccuccgccgcugccgctt

SEQ ID NO: 5865 - RNA, 19 nt, Artificial Sequence
  source: /note="Description of Artificial Sequence: Synthetic oligonucleotide"
agcggcggaggaggcagcg

SEQ ID NO: 5866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcggcggaggaggcagcgtt

SEQ ID NO: 5867 - RNA, 19 nt, Artificial Sequence
  source: /note="Description of Artificial Sequence: Synthetic oligonucleotide"
cgcugccuccuccgccgcu

SEQ ID NO: 5868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugccuccuccgccgcutt

SEQ ID NO: 5869 - RNA, 19 nt, Artificial Sequence
  source: /note="Description of Artificial Sequence: Synthetic oligonucleotide"
gcggcggaggaggcagcgg

SEQ ID NO: 5870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcggaggaggcagcggtt

SEQ ID NO: 5871 - RNA, 19 nt, Artificial Sequence
  source: /note="Description of Artificial Sequence: Synthetic oligonucleotide"
ccgcugccuccuccgccgc

SEQ ID NO: 5872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcugccuccuccgccgctt

SEQ ID NO: 5873 - RNA, 19 nt, Artificial Sequence
  source: /note="Description of Artificial Sequence: Synthetic oligonucleotide"
cggcggaggaggcagcggu

SEQ ID NO: 5874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcggaggaggcagcggutt

SEQ ID NO: 5875 - RNA, 19 nt, Artificial Sequence
  source: /note="Description of Artificial Sequence: Synthetic oligonucleotide"
accgcugccuccuccgccg

SEQ ID NO: 5876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcugccuccuccgccgtt

SEQ ID NO: 5877 - RNA, 19 nt, Artificial Sequence
  source: /note="Description of Artificial Sequence: Synthetic oligonucleotide"
ggcggaggaggcagcggug

SEQ ID NO: 5878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggaggaggcagcggugtt

SEQ ID NO: 5879 - RNA, 19 nt, Artificial Sequence
  source: /note="Description of Artificial Sequence: Synthetic oligonucleotide"
caccgcugccuccuccgcc

SEQ ID NO: 5880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccgcugccuccuccgcctt

SEQ ID NO: 5881 - RNA, 19 nt, Artificial Sequence
  source: /note="Description of Artificial Sequence: Synthetic oligonucleotide"
agcuucccgccgccgggag

SEQ ID NO: 5882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuucccgccgccgggagtt

SEQ ID NO: 5883 - RNA, 19 nt, Artificial Sequence
  source: /note="Description of Artificial Sequence: Synthetic oligonucleotide"
cucccggcggcgggaagcu

SEQ ID NO: 5884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccggcggcgggaagcutt

SEQ ID NO: 5885 - RNA, 19 nt, Artificial Sequence
  source: /note="Description of Artificial Sequence: Synthetic oligonucleotide"
agugaagcugggccgugac

SEQ ID NO: 5886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugaagcugggccgugactt

SEQ ID NO: 5887 - RNA, 19 nt, Artificial Sequence
  source: /note="Description of Artificial Sequence: Synthetic oligonucleotide"
gucacggcccagcuucacu

SEQ ID NO: 5888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucacggcccagcuucacutt

SEQ ID NO: 5889 - RNA, 19 nt, Artificial Sequence
  source: /note="Description of Artificial Sequence: Synthetic oligonucleotide"
ccacagugguagccacugu

SEQ ID NO: 5890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagugguagccacugutt

SEQ ID NO: 5891 - RNA, 19 nt, Artificial Sequence
  source: /note="Description of Artificial Sequence: Synthetic oligonucleotide"
acaguggcuaccacugugg

SEQ ID NO: 5892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguggcuaccacuguggtt

SEQ ID NO: 5893 - RNA, 19 nt, Artificial Sequence
  source: /note="Description of Artificial Sequence: Synthetic oligonucleotide"
ggccaaggcccagagcguu

SEQ ID NO: 5894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaaggcccagagcguutt

SEQ ID NO: 5895 - RNA, 19 nt, Artificial Sequence
  source: /note="Description of Artificial Sequence: Synthetic oligonucleotide"
aacgcucugggccuuggcc

SEQ ID NO: 5896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgcucugggccuuggcctt

SEQ ID NO: 5897 - RNA, 19 nt, Artificial Sequence
  source: /note="Description of Artificial Sequence: Synthetic oligonucleotide"
gcagagacgagggaacugg

SEQ ID NO: 5898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagacgagggaacuggtt

SEQ ID NO: 5899 - RNA, 19 nt, Artificial Sequence
  source: /note="Description of Artificial Sequence: Synthetic oligonucleotide"
ccaguucccucgucucugc

SEQ ID NO: 5900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaguucccucgucucugctt

SEQ ID NO: 5901 - RNA, 19 nt, Artificial Sequence
  source: /note="Description of Artificial Sequence: Synthetic oligonucleotide"
gggaacugguggccaucaa

SEQ ID NO: 5902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaacugguggccaucaatt

SEQ ID NO: 5903 - RNA, 19 nt, Artificial Sequence
  source: /note="Description of Artificial Sequence: Synthetic oligonucleotide"
uugauggccaccaguuccc

SEQ ID NO: 5904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugauggccaccaguuccctt

SEQ ID NO: 5905 - RNA, 19 nt, Artificial Sequence
  source: /note="Description of Artificial Sequence: Synthetic oligonucleotide"
acugguggccaucaagaag

SEQ ID NO: 5906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugguggccaucaagaagtt

SEQ ID NO: 5907 - RNA, 19 nt, Artificial Sequence
  source: /note="Description of Artificial Sequence: Synthetic oligonucleotide"
cuucuugauggccaccagu

SEQ ID NO: 5908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuugauggccaccagutt

SEQ ID NO: 5909 - RNA, 19 nt, Artificial Sequence
  source: /note="Description of Artificial Sequence: Synthetic oligonucleotide"
cugguggccaucaagaagg

SEQ ID NO: 5910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguggccaucaagaaggtt

SEQ ID NO: 5911 - RNA, 19 nt, Artificial Sequence
  source: /note="Description of Artificial Sequence: Synthetic oligonucleotide"
ccuucuugauggccaccag

SEQ ID NO: 5912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucuugauggccaccagtt

SEQ ID NO: 5913 - RNA, 19 nt, Artificial Sequence
  source: /note="Description of Artificial Sequence: Synthetic oligonucleotide"
aggcugcgguacuuuuucu

SEQ ID NO: 5914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcugcgguacuuuuucutt

SEQ ID NO: 5915 - RNA, 19 nt, Artificial Sequence
  source: /note="Description of Artificial Sequence: Synthetic oligonucleotide"
agaaaaaguaccgcagccu

SEQ ID NO: 5916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaaaguaccgcagccutt

SEQ ID NO: 5917 - RNA, 19 nt, Artificial Sequence
  source: /note="Description of Artificial Sequence: Synthetic oligonucleotide"
ggcugcgguacuuuuucua

SEQ ID NO: 5918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugcgguacuuuuucuatt

SEQ ID NO: 5919 - RNA, 19 nt, Artificial Sequence
  source: /note="Description of Artificial Sequence: Synthetic oligonucleotide"
uagaaaaaguaccgcagcc

SEQ ID NO: 5920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaaaaaguaccgcagcctt

SEQ ID NO: 5921 - RNA, 19 nt, Artificial Sequence
  source: /note="Description of Artificial Sequence: Synthetic oligonucleotide"
gcgguacuuuuucuacucc

SEQ ID NO: 5922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgguacuuuuucuacucctt

SEQ ID NO: 5923 - RNA, 19 nt, Artificial Sequence
  source: /note="Description of Artificial Sequence: Synthetic oligonucleotide"
ggaguagaaaaaguaccgc

SEQ ID NO: 5924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguagaaaaaguaccgctt

SEQ ID NO: 5925 - RNA, 19 nt, Artificial Sequence
  source: /note="Description of Artificial Sequence: Synthetic oligonucleotide"
caucaagguguacauguac

SEQ ID NO: 5926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagguguacauguactt

SEQ ID NO: 5927 - RNA, 19 nt, Artificial Sequence
  source: /note="Description of Artificial Sequence: Synthetic oligonucleotide"
guacauguacaccuugaug

SEQ ID NO: 5928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacauguacaccuugaugtt

SEQ ID NO: 5929 - RNA, 19 nt, Artificial Sequence
  source: /note="Description of Artificial Sequence: Synthetic oligonucleotide"
uacauccacucccaaggug

SEQ ID NO: 5930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacauccacucccaaggugtt

SEQ ID NO: 5931 - RNA, 19 nt, Artificial Sequence
  source: /note="Description of Artificial Sequence: Synthetic oligonucleotide"
caccuugggaguggaugua

SEQ ID NO: 5932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuugggaguggauguatt

SEQ ID NO: 5933 - RNA, 19 nt, Artificial Sequence
  source: /note="Description of Artificial Sequence: Synthetic oligonucleotide"
gacccugacacugcugucc

SEQ ID NO: 5934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacccugacacugcugucctt

SEQ ID NO: 5935 - RNA, 19 nt, Artificial Sequence
  source: /note="Description of Artificial Sequence: Synthetic oligonucleotide"
ggacagcagugucaggguc

SEQ ID NO: 5936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacagcagugucaggguctt

SEQ ID NO: 5937 - RNA, 19 nt, Artificial Sequence
  source: /note="Description of Artificial Sequence: Synthetic oligonucleotide"
ccugacacugcuguccuca

SEQ ID NO: 5938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugacacugcuguccucatt

SEQ ID NO: 5939 - RNA, 19 nt, Artificial Sequence
  source: /note="Description of Artificial Sequence: Synthetic oligonucleotide"
ugaggacagcagugucagg

SEQ ID NO: 5940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggacagcagugucaggtt

SEQ ID NO: 5941 - RNA, 19 nt, Artificial Sequence
  source: /note="Description of Artificial Sequence: Synthetic oligonucleotide"
acacugcuguccucaagcu

SEQ ID NO: 5942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacugcuguccucaagcutt

SEQ ID NO: 5943 - RNA, 19 nt, Artificial Sequence
  source: /note="Description of Artificial Sequence: Synthetic oligonucleotide"
agcuugaggacagcagugu

SEQ ID NO: 5944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuugaggacagcagugutt

SEQ ID NO: 5945 - RNA, 19 nt, Artificial Sequence
  source: /note="Description of Artificial Sequence: Synthetic oligonucleotide"
cacugcuguccucaagcuc

SEQ ID NO: 5946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugcuguccucaagcuctt

SEQ ID NO: 5947 - RNA, 19 nt, Artificial Sequence
  source: /note="Description of Artificial Sequence: Synthetic oligonucleotide"
gagcuugaggacagcagug

SEQ ID NO: 5948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuugaggacagcagugtt

SEQ ID NO: 5949 - RNA, 19 nt, Artificial Sequence
  source: /note="Description of Artificial Sequence: Synthetic oligonucleotide"
cugcuguccucaagcucug

SEQ ID NO: 5950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuguccucaagcucugtt

SEQ ID NO: 5951 - RNA, 19 nt, Artificial Sequence
  source: /note="Description of Artificial Sequence: Synthetic oligonucleotide"
cagagcuugaggacagcag

SEQ ID NO: 5952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagcuugaggacagcagtt

SEQ ID NO: 5953 - RNA, 19 nt, Artificial Sequence
  source: /note="Description of Artificial Sequence: Synthetic oligonucleotide"
ugcuguccucaagcucugc

SEQ ID NO: 5954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuguccucaagcucugctt

SEQ ID NO: 5955 - RNA, 19 nt, Artificial Sequence
  source: /note="Description of Artificial Sequence: Synthetic oligonucleotide"
gcagagcuugaggacagca

SEQ ID NO: 5956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagcuugaggacagcatt

SEQ ID NO: 5957 - RNA, 19 nt, Artificial Sequence
  source: /note="Description of Artificial Sequence: Synthetic oligonucleotide"
caucugcucucgguacuac

SEQ ID NO: 5958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucugcucucgguacuactt

SEQ ID NO: 5959 - RNA, 19 nt, Artificial Sequence
  source: /note="Description of Artificial Sequence: Synthetic oligonucleotide"
guaguaccgagagcagaug

SEQ ID NO: 5960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaguaccgagagcagaugtt

SEQ ID NO: 5961 - RNA, 19 nt, Artificial Sequence
  source: /note="Description of Artificial Sequence: Synthetic oligonucleotide"
uccagaacucaucuuugga

SEQ ID NO: 5962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagaacucaucuuuggatt

SEQ ID NO: 5963 - RNA, 19 nt, Artificial Sequence
  source: /note="Description of Artificial Sequence: Synthetic oligonucleotide"
uccaaagaugaguucugga

SEQ ID NO: 5964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaagaugaguucuggatt

SEQ ID NO: 5965 - RNA, 19 nt, Artificial Sequence
  source: /note="Description of Artificial Sequence: Synthetic oligonucleotide"
ccucguccaucgaugugug

SEQ ID NO: 5966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucguccaucgaugugugtt

SEQ ID NO: 5967 - RNA, 19 nt, Artificial Sequence
  source: /note="Description of Artificial Sequence: Synthetic oligonucleotide"
cacacaucgauggacgagg

SEQ ID NO: 5968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacacaucgauggacgaggtt

SEQ ID NO: 5969 - RNA, 19 nt, Artificial Sequence
  source: /note="Description of Artificial Sequence: Synthetic oligonucleotide"
gucggcuggcuguguacuu

SEQ ID NO: 5970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucggcuggcuguguacuutt

SEQ ID NO: 5971 - RNA, 19 nt, Artificial Sequence
  source: /note="Description of Artificial Sequence: Synthetic oligonucleotide"
aaguacacagccagccgac

SEQ ID NO: 5972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguacacagccagccgactt

SEQ ID NO: 5973 - RNA, 19 nt, Artificial Sequence
  source: /note="Description of Artificial Sequence: Synthetic oligonucleotide"
gcuguguacuugcugagcu

SEQ ID NO: 5974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguguacuugcugagcutt

SEQ ID NO: 5975 - RNA, 19 nt, Artificial Sequence
  source: /note="Description of Artificial Sequence: Synthetic oligonucleotide"
agcucagcaaguacacagc

SEQ ID NO: 5976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucagcaaguacacagctt

SEQ ID NO: 5977 - RNA, 19 nt, Artificial Sequence
  source: /note="Description of Artificial Sequence: Synthetic oligonucleotide"
guacuugcugagcuacuuc

SEQ ID NO: 5978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuugcugagcuacuuctt

SEQ ID NO: 5979 - RNA, 19 nt, Artificial Sequence
  source: /note="Description of Artificial Sequence: Synthetic oligonucleotide"
gaaguagcucagcaaguac

SEQ ID NO: 5980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaguagcucagcaaguactt

SEQ ID NO: 5981 - RNA, 19 nt, Artificial Sequence
  source: /note="Description of Artificial Sequence: Synthetic oligonucleotide"
uucucggccagcccaucuu

SEQ ID NO: 5982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucggccagcccaucuutt

SEQ ID NO: 5983 - RNA, 19 nt, Artificial Sequence
  source: /note="Description of Artificial Sequence: Synthetic oligonucleotide"
aagaugggcuggccgagaa

SEQ ID NO: 5984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaugggcuggccgagaatt

SEQ ID NO: 5985 - RNA, 19 nt, Artificial Sequence
  source: /note="Description of Artificial Sequence: Synthetic oligonucleotide"
ucucggccagcccaucuuc

SEQ ID NO: 5986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucggccagcccaucuuctt

SEQ ID NO: 5987 - RNA, 19 nt, Artificial Sequence
  source: /note="Description of Artificial Sequence: Synthetic oligonucleotide"
gaagaugggcuggccgaga

SEQ ID NO: 5988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaugggcuggccgagatt

SEQ ID NO: 5989 - RNA, 19 nt, Artificial Sequence
  source: /note="Description of Artificial Sequence: Synthetic oligonucleotide"
cggccagcccaucuucccu

SEQ ID NO: 5990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccagcccaucuucccutt

SEQ ID NO: 5991 - RNA, 19 nt, Artificial Sequence
  source: /note="Description of Artificial Sequence: Synthetic oligonucleotide"
agggaagaugggcuggccg

SEQ ID NO: 5992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaagaugggcuggccgtt

SEQ ID NO: 5993 - RNA, 19 nt, Artificial Sequence
  source: /note="Description of Artificial Sequence: Synthetic oligonucleotide"
cccaucuucccuggggaca

SEQ ID NO: 5994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaucuucccuggggacatt

SEQ ID NO: 5995 - RNA, 19 nt, Artificial Sequence
  source: /note="Description of Artificial Sequence: Synthetic oligonucleotide"
uguccccagggaagauggg

SEQ ID NO: 5996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccccagggaagaugggtt

SEQ ID NO: 5997 - RNA, 19 nt, Artificial Sequence
  source: /note="Description of Artificial Sequence: Synthetic oligonucleotide"
ucuucccuggggacagugg

SEQ ID NO: 5998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucccuggggacaguggtt

SEQ ID NO: 5999 - RNA, 19 nt, Artificial Sequence
  source: /note="Description of Artificial Sequence: Synthetic oligonucleotide"
ccacuguccccagggaaga

SEQ ID NO: 6000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuguccccagggaagatt

SEQ ID NO: 6001 - RNA, 19 nt, Artificial Sequence
  source: /note="Description of Artificial Sequence: Synthetic oligonucleotide"
ccuggggacaguggggugg

SEQ ID NO: 6002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggggacagugggguggtt

SEQ ID NO: 6003 - RNA, 19 nt, Artificial Sequence
  source: /note="Description of Artificial Sequence: Synthetic oligonucleotide"
ccaccccacuguccccagg

SEQ ID NO: 6004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccccacuguccccaggtt

SEQ ID NO: 6005 - RNA, 19 nt, Artificial Sequence
  source: /note="Description of Artificial Sequence: Synthetic oligonucleotide"
agugggguggaccagcuug

SEQ ID NO: 6006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugggguggaccagcuugtt

SEQ ID NO: 6007 - RNA, 19 nt, Artificial Sequence
  source: /note="Description of Artificial Sequence: Synthetic oligonucleotide"
caagcugguccaccccacu

SEQ ID NO: 6008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcugguccaccccacutt

SEQ ID NO: 6009 - RNA, 19 nt, Artificial Sequence
  source: /note="Description of Artificial Sequence: Synthetic oligonucleotide"
cccuuggacaaagguguuc

SEQ ID NO: 6010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuuggacaaagguguuctt

SEQ ID NO: 6011 - RNA, 19 nt, Artificial Sequence
  source: /note="Description of Artificial Sequence: Synthetic oligonucleotide"
gaacaccuuuguccaaggg

SEQ ID NO: 6012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacaccuuuguccaagggtt

SEQ ID NO: 6013 - RNA, 19 nt, Artificial Sequence
  source: /note="Description of Artificial Sequence: Synthetic oligonucleotide"
aucuucaaagacaccaccu

SEQ ID NO: 6014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuucaaagacaccaccutt

SEQ ID NO: 6015 - RNA, 19 nt, Artificial Sequence
  source: /note="Description of Artificial Sequence: Synthetic oligonucleotide"
agguggugucuuugaagau

SEQ ID NO: 6016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguggugucuuugaagautt

SEQ ID NO: 6017 - RNA, 19 nt, Artificial Sequence
  source: /note="Description of Artificial Sequence: Synthetic oligonucleotide"
cuucaaagacaccaccuga

SEQ ID NO: 6018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaaagacaccaccugatt

SEQ ID NO: 6019 - RNA, 19 nt, Artificial Sequence
  source: /note="Description of Artificial Sequence: Synthetic oligonucleotide"
ucagguggugucuuugaag

SEQ ID NO: 6020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagguggugucuuugaagtt

SEQ ID NO: 6021 - RNA, 19 nt, Artificial Sequence
  source: /note="Description of Artificial Sequence: Synthetic oligonucleotide"
uucaaagacaccaccugag

SEQ ID NO: 6022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaaagacaccaccugagtt

SEQ ID NO: 6023 - RNA, 19 nt, Artificial Sequence
  source: /note="Description of Artificial Sequence: Synthetic oligonucleotide"
cucagguggugucuuugaa

SEQ ID NO: 6024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucagguggugucuuugaatt

SEQ ID NO: 6025 - RNA, 19 nt, Artificial Sequence
  source: /note="Description of Artificial Sequence: Synthetic oligonucleotide"
cauccucaaggcucucccc

SEQ ID NO: 6026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccucaaggcucucccctt

SEQ ID NO: 6027 - RNA, 19 nt, Artificial Sequence
  source: /note="Description of Artificial Sequence: Synthetic oligonucleotide"
ggggagagccuugaggaug

SEQ ID NO: 6028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagagccuugaggaugtt

SEQ ID NO: 6029 - RNA, 19 nt, Artificial Sequence
  source: /note="Description of Artificial Sequence: Synthetic oligonucleotide"
cccacagcuucuucgauga

SEQ ID NO: 6030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacagcuucuucgaugatt

SEQ ID NO: 6031 - RNA, 19 nt, Artificial Sequence
  source: /note="Description of Artificial Sequence: Synthetic oligonucleotide"
ucaucgaagaagcuguggg

SEQ ID NO: 6032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucgaagaagcugugggtt

SEQ ID NO: 6033 - RNA, 19 nt, Artificial Sequence
  source: /note="Description of Artificial Sequence: Synthetic oligonucleotide"
cucggagcccagcucccca

SEQ ID NO: 6034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggagcccagcuccccatt

SEQ ID NO: 6035 - RNA, 19 nt, Artificial Sequence
  source: /note="Description of Artificial Sequence: Synthetic oligonucleotide"
uggggagcugggcuccgag

SEQ ID NO: 6036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggagcugggcuccgagtt

SEQ ID NO: 6037 - RNA, 19 nt, Artificial Sequence
  source: /note="Description of Artificial Sequence: Synthetic oligonucleotide"
cggagcccagcuccccaac

SEQ ID NO: 6038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagcccagcuccccaactt

SEQ ID NO: 6039 - RNA, 19 nt, Artificial Sequence
  source: /note="Description of Artificial Sequence: Synthetic oligonucleotide"
guuggggagcugggcuccg

SEQ ID NO: 6040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuggggagcugggcuccgtt

SEQ ID NO: 6041 - RNA, 19 nt, Artificial Sequence
  source: /note="Description of Artificial Sequence: Synthetic oligonucleotide"
ucucucaaugccauucuca

SEQ ID NO: 6042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucucaaugccauucucatt

SEQ ID NO: 6043 - RNA, 19 nt, Artificial Sequence
  source: /note="Description of Artificial Sequence: Synthetic oligonucleotide"
ugagaauggcauugagaga

SEQ ID NO: 6044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagaauggcauugagagatt

SEQ ID NO: 6045 - RNA, 19 nt, Artificial Sequence
  source: /note="Description of Artificial Sequence: Synthetic oligonucleotide"
cucaaugccauucucaucc

SEQ ID NO: 6046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaaugccauucucaucctt

SEQ ID NO: 6047 - RNA, 19 nt, Artificial Sequence
  source: /note="Description of Artificial Sequence: Synthetic oligonucleotide"
ggaugagaauggcauugag

SEQ ID NO: 6048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaugagaauggcauugagtt

SEQ ID NO: 6049 - RNA, 19 nt, Artificial Sequence
  source: /note="Description of Artificial Sequence: Synthetic oligonucleotide"
ucaaugccauucucauccc

SEQ ID NO: 6050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaugccauucucauccctt

SEQ ID NO: 6051 - RNA, 19 nt, Artificial Sequence
  source: /note="Description of Artificial Sequence: Synthetic oligonucleotide"
gggaugagaauggcauuga

SEQ ID NO: 6052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaugagaauggcauugatt

SEQ ID NO: 6053 - RNA, 19 nt, Artificial Sequence
  source: /note="Description of Artificial Sequence: Synthetic oligonucleotide"
caggcccugcuucuccccu

SEQ ID NO: 6054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcccugcuucuccccutt

SEQ ID NO: 6055 - RNA, 19 nt, Artificial Sequence
  source: /note="Description of Artificial Sequence: Synthetic oligonucleotide"
aggggagaagcagggccug

SEQ ID NO: 6056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggagaagcagggccugtt

SEQ ID NO: 6057 - RNA, 19 nt, Artificial Sequence
  source: /note="Description of Artificial Sequence: Synthetic oligonucleotide"
ugcuucuccccucaccacu

SEQ ID NO: 6058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuucuccccucaccacutt

SEQ ID NO: 6059 - RNA, 19 nt, Artificial Sequence
  source: /note="Description of Artificial Sequence: Synthetic oligonucleotide"
aguggugaggggagaagca

SEQ ID NO: 6060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggugaggggagaagcatt

SEQ ID NO: 6061 - RNA, 19 nt, Artificial Sequence
  source: /note="Description of Artificial Sequence: Synthetic oligonucleotide"
agcuuuaacugaagcucag

SEQ ID NO: 6062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuuaacugaagcucagtt

SEQ ID NO: 6063 - RNA, 19 nt, Artificial Sequence
  source: /note="Description of Artificial Sequence: Synthetic oligonucleotide"
cugagcuucaguuaaagcu

SEQ ID NO: 6064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugagcuucaguuaaagcutt

SEQ ID NO: 6065 - RNA, 19 nt, Artificial Sequence
  source: /note="Description of Artificial Sequence: Synthetic oligonucleotide"
agccaucugaugccacaac

SEQ ID NO: 6066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccaucugaugccacaactt

SEQ ID NO: 6067 - RNA, 19 nt, Artificial Sequence
  source: /note="Description of Artificial Sequence: Synthetic oligonucleotide"
guuguggcaucagauggcu

SEQ ID NO: 6068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuguggcaucagauggcutt

SEQ ID NO: 6069 - RNA, 19 nt, Artificial Sequence
  source: /note="Description of Artificial Sequence: Synthetic oligonucleotide"
agccuaaccucuguggugg

SEQ ID NO: 6070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuaaccucugugguggtt

SEQ ID NO: 6071 - RNA, 19 nt, Artificial Sequence
  source: /note="Description of Artificial Sequence: Synthetic oligonucleotide"
ccaccacagagguuaggcu

SEQ ID NO: 6072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccacagagguuaggcutt

SEQ ID NO: 6073 - RNA, 19 nt, Artificial Sequence
  source: /note="Description of Artificial Sequence: Synthetic oligonucleotide"
uaggggaggggagaaaagg

SEQ ID NO: 6074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggggaggggagaaaaggtt

SEQ ID NO: 6075 - RNA, 19 nt, Artificial Sequence
  source: /note="Description of Artificial Sequence: Synthetic oligonucleotide"
ccuuuucuccccuccccua

SEQ ID NO: 6076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuucuccccuccccuatt

SEQ ID NO: 6077 - RNA, 19 nt, Artificial Sequence
  source: /note="Description of Artificial Sequence: Synthetic oligonucleotide"
aggggaggggagaaaagga

SEQ ID NO: 6078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggaggggagaaaaggatt

SEQ ID NO: 6079 - RNA, 19 nt, Artificial Sequence
  source: /note="Description of Artificial Sequence: Synthetic oligonucleotide"
uccuuuucuccccuccccu

SEQ ID NO: 6080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuuucuccccuccccutt

SEQ ID NO: 6081 - RNA, 19 nt, Artificial Sequence
  source: /note="Description of Artificial Sequence: Synthetic oligonucleotide"
ggggaggggagaaaaggaa

SEQ ID NO: 6082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaggggagaaaaggaatt

SEQ ID NO: 6083 - RNA, 19 nt, Artificial Sequence
  source: /note="Description of Artificial Sequence: Synthetic oligonucleotide"
uuccuuuucuccccucccc

SEQ ID NO: 6084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuuuucuccccucccctt

SEQ ID NO: 6085 - RNA, 19 nt, Artificial Sequence
  source: /note="Description of Artificial Sequence: Synthetic oligonucleotide"
gggaggggagaaaaggaag

SEQ ID NO: 6086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggggagaaaaggaagtt

SEQ ID NO: 6087 - RNA, 19 nt, Artificial Sequence
  source: /note="Description of Artificial Sequence: Synthetic oligonucleotide"
cuuccuuuucuccccuccc

SEQ ID NO: 6088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccuuuucuccccuccctt

SEQ ID NO: 6089 - RNA, 19 nt, Artificial Sequence
  source: /note="Description of Artificial Sequence: Synthetic oligonucleotide"
ggggagaaaaggaaggacg

SEQ ID NO: 6090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagaaaaggaaggacgtt

SEQ ID NO: 6091 - RNA, 19 nt, Artificial Sequence
  source: /note="Description of Artificial Sequence: Synthetic oligonucleotide"
cguccuuccuuuucucccc

SEQ ID NO: 6092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguccuuccuuuucucccctt

SEQ ID NO: 6093 - RNA, 19 nt, Artificial Sequence
  source: /note="Description of Artificial Sequence: Synthetic oligonucleotide"
gugugaggaccuucuaccc

SEQ ID NO: 6094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugugaggaccuucuaccctt

SEQ ID NO: 6095 - RNA, 19 nt, Artificial Sequence
  source: /note="Description of Artificial Sequence: Synthetic oligonucleotide"
ggguagaagguccucacac

SEQ ID NO: 6096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguagaagguccucacactt

SEQ ID NO: 6097 - RNA, 19 nt, Artificial Sequence
  source: /note="Description of Artificial Sequence: Synthetic oligonucleotide"
ccuccccucccccaggcua

SEQ ID NO: 6098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccccucccccaggcuatt

SEQ ID NO: 6099 - RNA, 19 nt, Artificial Sequence
  source: /note="Description of Artificial Sequence: Synthetic oligonucleotide"
uagccugggggaggggagg

SEQ ID NO: 6100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccugggggaggggaggtt

SEQ ID NO: 6101 - RNA, 19 nt, Artificial Sequence
  source: /note="Description of Artificial Sequence: Synthetic oligonucleotide"
cuccccucccccaggcuac

SEQ ID NO: 6102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccucccccaggcuactt

SEQ ID NO: 6103 - RNA, 19 nt, Artificial Sequence
  source: /note="Description of Artificial Sequence: Synthetic oligonucleotide"
guagccugggggaggggag

SEQ ID NO: 6104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagccugggggaggggagtt

SEQ ID NO: 6105 - RNA, 19 nt, Artificial Sequence
  source: /note="Description of Artificial Sequence: Synthetic oligonucleotide"
accacuccuucccuccccc

SEQ ID NO: 6106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuccuucccuccccctt

SEQ ID NO: 6107 - RNA, 19 nt, Artificial Sequence
  source: /note="Description of Artificial Sequence: Synthetic oligonucleotide"
gggggagggaaggaguggu

SEQ ID NO: 6108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggagggaaggaguggutt

SEQ ID NO: 6109 - RNA, 19 nt, Artificial Sequence
  source: /note="Description of Artificial Sequence: Synthetic oligonucleotide"
ccacuccuucccucccccc

SEQ ID NO: 6110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuccuucccucccccctt

SEQ ID NO: 6111 - RNA, 19 nt, Artificial Sequence
  source: /note="Description of Artificial Sequence: Synthetic oligonucleotide"
ggggggagggaaggagugg

SEQ ID NO: 6112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggggagggaaggaguggtt

SEQ ID NO: 6113 - RNA, 19 nt, Artificial Sequence
  source: /note="Description of Artificial Sequence: Synthetic oligonucleotide"
cacuccuucccuccccccc

SEQ ID NO: 6114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuccuucccuccccccctt

SEQ ID NO: 6115 - RNA, 19 nt, Artificial Sequence
  source: /note="Description of Artificial Sequence: Synthetic oligonucleotide"
gggggggagggaaggagug

SEQ ID NO: 6116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggggagggaaggagugtt

SEQ ID NO: 6117 - RNA, 19 nt, Artificial Sequence
  source: /note="Description of Artificial Sequence: Synthetic oligonucleotide"
acuccuucccucccccccu

SEQ ID NO: 6118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccuucccucccccccutt

SEQ ID NO: 6119 - RNA, 19 nt, Artificial Sequence
  source: /note="Description of Artificial Sequence: Synthetic oligonucleotide"
agggggggagggaaggagu

SEQ ID NO: 6120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggggggagggaaggagutt

SEQ ID NO: 6121 - RNA, 19 nt, Artificial Sequence
  source: /note="Description of Artificial Sequence: Synthetic oligonucleotide"
cuccuucccucccccccuc

SEQ ID NO: 6122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuucccucccccccuctt

SEQ ID NO: 6123 - RNA, 19 nt, Artificial Sequence
  source: /note="Description of Artificial Sequence: Synthetic oligonucleotide"
gagggggggagggaaggag

SEQ ID NO: 6124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggggggagggaaggagtt

SEQ ID NO: 6125 - RNA, 19 nt, Artificial Sequence
  source: /note="Description of Artificial Sequence: Synthetic oligonucleotide"
uucccucccccccucuccc

SEQ ID NO: 6126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccucccccccucuccctt

SEQ ID NO: 6127 - RNA, 19 nt, Artificial Sequence
  source: /note="Description of Artificial Sequence: Synthetic oligonucleotide"
gggagagggggggagggaa

SEQ ID NO: 6128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagagggggggagggaatt

SEQ ID NO: 6129 - RNA, 19 nt, Artificial Sequence
  source: /note="Description of Artificial Sequence: Synthetic oligonucleotide"
ucccucccccccucuccca

SEQ ID NO: 6130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucccccccucucccatt

SEQ ID NO: 6131 - RNA, 19 nt, Artificial Sequence
  source: /note="Description of Artificial Sequence: Synthetic oligonucleotide"
ugggagagggggggaggga

SEQ ID NO: 6132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggagagggggggagggatt

SEQ ID NO: 6133 - RNA, 19 nt, Artificial Sequence
  source: /note="Description of Artificial Sequence: Synthetic oligonucleotide"
cccucucccaggucccuug

SEQ ID NO: 6134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucucccaggucccuugtt

SEQ ID NO: 6135 - RNA, 19 nt, Artificial Sequence
  source: /note="Description of Artificial Sequence: Synthetic oligonucleotide"
caagggaccugggagaggg

SEQ ID NO: 6136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagggaccugggagagggtt

SEQ ID NO: 6137 - RNA, 19 nt, Artificial Sequence
  source: /note="Description of Artificial Sequence: Synthetic oligonucleotide"
cccaggucccuuguaaaua

SEQ ID NO: 6138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggucccuuguaaauatt

SEQ ID NO: 6139 - RNA, 19 nt, Artificial Sequence
  source: /note="Description of Artificial Sequence: Synthetic oligonucleotide"
uauuuacaagggaccuggg

SEQ ID NO: 6140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuuacaagggaccugggtt

SEQ ID NO: 6141 - RNA, 19 nt, Artificial Sequence
  source: /note="Description of Artificial Sequence: Synthetic oligonucleotide"
uagaaccagcccagcccau

SEQ ID NO: 6142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaaccagcccagcccautt

SEQ ID NO: 6143 - RNA, 19 nt, Artificial Sequence
  source: /note="Description of Artificial Sequence: Synthetic oligonucleotide"
augggcugggcugguucua

SEQ ID NO: 6144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augggcugggcugguucuatt

SEQ ID NO: 6145 - RNA, 19 nt, Artificial Sequence
  source: /note="Description of Artificial Sequence: Synthetic oligonucleotide"
aucucucgucuucccuucc

SEQ ID NO: 6146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucucucgucuucccuucctt

SEQ ID NO: 6147 - RNA, 19 nt, Artificial Sequence
  source: /note="Description of Artificial Sequence: Synthetic oligonucleotide"
ggaagggaagacgagagau

SEQ ID NO: 6148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagggaagacgagagautt

SEQ ID NO: 6149 - RNA, 19 nt, Artificial Sequence
  source: /note="Description of Artificial Sequence: Synthetic oligonucleotide"
ucucucgucuucccuuccc

SEQ ID NO: 6150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucucgucuucccuuccctt

SEQ ID NO: 6151 - RNA, 19 nt, Artificial Sequence
  source: /note="Description of Artificial Sequence: Synthetic oligonucleotide"
gggaagggaagacgagaga

SEQ ID NO: 6152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagggaagacgagagatt

SEQ ID NO: 6153 - RNA, 19 nt, Artificial Sequence
  source: /note="Description of Artificial Sequence: Synthetic oligonucleotide"
uucccuggcccccugggug

SEQ ID NO: 6154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccuggcccccugggugtt

SEQ ID NO: 6155 - RNA, 19 nt, Artificial Sequence
  source: /note="Description of Artificial Sequence: Synthetic oligonucleotide"
cacccagggggccagggaa

SEQ ID NO: 6156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacccagggggccagggaatt

SEQ ID NO: 6157 - RNA, 19 nt, Artificial Sequence
  source: /note="Description of Artificial Sequence: Synthetic oligonucleotide"
uaaauagauuguuauaauu

SEQ ID NO: 6158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaauagauuguuauaauutt

SEQ ID NO: 6159 - RNA, 19 nt, Artificial Sequence
  source: /note="Description of Artificial Sequence: Synthetic oligonucleotide"
aauuauaacaaucuauuua

SEQ ID NO: 6160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuauaacaaucuauuuatt

SEQ ID NO: 6161 - RNA, 19 nt, Artificial Sequence
  source: /note="Description of Artificial Sequence: Synthetic oligonucleotide"
uuauaauuuuuucuuaaag

SEQ ID NO: 6162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauaauuuuuucuuaaagtt

SEQ ID NO: 6163 - RNA, 19 nt, Artificial Sequence
  source: /note="Description of Artificial Sequence: Synthetic oligonucleotide"
cuuuaagaaaaaauuauaa

SEQ ID NO: 6164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuaagaaaaaauuauaatt

SEQ ID NO: 6165 - RNA, 19 nt, Artificial Sequence
  source: /note="Description of Artificial Sequence: Synthetic oligonucleotide"
auaauuuuuucuuaaagaa

SEQ ID NO: 6166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaauuuuuucuuaaagaatt

SEQ ID NO: 6167 - RNA, 19 nt, Artificial Sequence
  source: /note="Description of Artificial Sequence: Synthetic oligonucleotide"
uucuuuaagaaaaaauuau

SEQ ID NO: 6168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuuuaagaaaaaauuautt

SEQ ID NO: 6169 - RNA, 19 nt, Artificial Sequence
  source: /note="Description of Artificial Sequence: Synthetic oligonucleotide"
uaauuuuuucuuaaagaaa

SEQ ID NO: 6170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauuuuuucuuaaagaaatt

SEQ ID NO: 6171 - RNA, 19 nt, Artificial Sequence
  source: /note="Description of Artificial Sequence: Synthetic oligonucleotide"
uuucuuuaagaaaaaauua

SEQ ID NO: 6172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuuuaagaaaaaauuatt

SEQ ID NO: 6173 - RNA, 19 nt, Artificial Sequence
  source: /note="Description of Artificial Sequence: Synthetic oligonucleotide"
aauuuuuucuuaaagaaaa

SEQ ID NO: 6174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuuuuucuuaaagaaaatt

SEQ ID NO: 6175 - RNA, 19 nt, Artificial Sequence
  source: /note="Description of Artificial Sequence: Synthetic oligonucleotide"
uuuucuuuaagaaaaaauu

SEQ ID NO: 6176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuucuuuaagaaaaaauutt

SEQ ID NO: 6177 - RNA, 19 nt, Artificial Sequence
  source: /note="Description of Artificial Sequence: Synthetic oligonucleotide"
uaccccuucuuguccucug

SEQ ID NO: 6178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccccuucuuguccucugtt

SEQ ID NO: 6179 - RNA, 19 nt, Artificial Sequence
  source: /note="Description of Artificial Sequence: Synthetic oligonucleotide"
cagaggacaagaaggggua

SEQ ID NO: 6180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaggacaagaagggguatt

SEQ ID NO: 6181 - RNA, 19 nt, Artificial Sequence
  source: /note="Description of Artificial Sequence: Synthetic oligonucleotide"
ccccuucuuguccucugcu

SEQ ID NO: 6182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuucuuguccucugcutt

SEQ ID NO: 6183 - RNA, 19 nt, Artificial Sequence
  source: /note="Description of Artificial Sequence: Synthetic oligonucleotide"
agcagaggacaagaagggg

SEQ ID NO: 6184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagaggacaagaaggggtt

SEQ ID NO: 6185 - RNA, 19 nt, Artificial Sequence
  source: /note="Description of Artificial Sequence: Synthetic oligonucleotide"
cccuucuuguccucugcuc

SEQ ID NO: 6186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuucuuguccucugcuctt

SEQ ID NO: 6187 - RNA, 19 nt, Artificial Sequence
  source: /note="Description of Artificial Sequence: Synthetic oligonucleotide"
gagcagaggacaagaaggg

SEQ ID NO: 6188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcagaggacaagaagggtt

SEQ ID NO: 6189 - RNA, 19 nt, Artificial Sequence
  source: /note="Description of Artificial Sequence: Synthetic oligonucleotide"
ccuucuuguccucugcucc

SEQ ID NO: 6190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucuuguccucugcucctt

SEQ ID NO: 6191 - RNA, 19 nt, Artificial Sequence
  source: /note="Description of Artificial Sequence: Synthetic oligonucleotide"
ggagcagaggacaagaagg

SEQ ID NO: 6192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcagaggacaagaaggtt

SEQ ID NO: 6193 - RNA, 19 nt, Artificial Sequence
  source: /note="Description of Artificial Sequence: Synthetic oligonucleotide"
cuucuuguccucugcuccc

SEQ ID NO: 6194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuuguccucugcuccctt

SEQ ID NO: 6195 - RNA, 19 nt, Artificial Sequence
  source: /note="Description of Artificial Sequence: Synthetic oligonucleotide"
gggagcagaggacaagaag

SEQ ID NO: 6196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagcagaggacaagaagtt

SEQ ID NO: 6197 - RNA, 19 nt, Artificial Sequence
  source: /note="Description of Artificial Sequence: Synthetic oligonucleotide"
cugcucccaaggcuuccuc

SEQ ID NO: 6198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcucccaaggcuuccuctt

SEQ ID NO: 6199 - RNA, 19 nt, Artificial Sequence
  source: /note="Description of Artificial Sequence: Synthetic oligonucleotide"
gaggaagccuugggagcag

SEQ ID NO: 6200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggaagccuugggagcagtt

SEQ ID NO: 6201 - RNA, 19 nt, Artificial Sequence
  source: /note="Description of Artificial Sequence: Synthetic oligonucleotide"
cccaaggcuuccucccucu

SEQ ID NO: 6202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaaggcuuccucccucutt

SEQ ID NO: 6203 - RNA, 19 nt, Artificial Sequence
  source: /note="Description of Artificial Sequence: Synthetic oligonucleotide"
agagggaggaagccuuggg

SEQ ID NO: 6204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagggaggaagccuugggtt

SEQ ID NO: 6205 - RNA, 19 nt, Artificial Sequence
  source: /note="Description of Artificial Sequence: Synthetic oligonucleotide"
gcuuccucccucuccccau

SEQ ID NO: 6206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuccucccucuccccautt

SEQ ID NO: 6207 - RNA, 19 nt, Artificial Sequence
  source: /note="Description of Artificial Sequence: Synthetic oligonucleotide"
auggggagagggaggaagc

SEQ ID NO: 6208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggggagagggaggaagctt

SEQ ID NO: 6209 - RNA, 19 nt, Artificial Sequence
  source: /note="Description of Artificial Sequence: Synthetic oligonucleotide"
cuuccucccucuccccauc

SEQ ID NO: 6210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccucccucuccccauctt

SEQ ID NO: 6211 - RNA, 19 nt, Artificial Sequence
  source: /note="Description of Artificial Sequence: Synthetic oligonucleotide"
gauggggagagggaggaag

SEQ ID NO: 6212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggggagagggaggaagtt

SEQ ID NO: 6213 - RNA, 19 nt, Artificial Sequence
  source: /note="Description of Artificial Sequence: Synthetic oligonucleotide"
uccucccucuccccauccu

SEQ ID NO: 6214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucccucuccccauccutt

SEQ ID NO: 6215 - RNA, 19 nt, Artificial Sequence
  source: /note="Description of Artificial Sequence: Synthetic oligonucleotide"
aggauggggagagggagga

SEQ ID NO: 6216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggauggggagagggaggatt

SEQ ID NO: 6217 - RNA, 19 nt, Artificial Sequence
  source: /note="Description of Artificial Sequence: Synthetic oligonucleotide"
ccucccucuccccauccug

SEQ ID NO: 6218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucccucuccccauccugtt

SEQ ID NO: 6219 - RNA, 19 nt, Artificial Sequence
  source: /note="Description of Artificial Sequence: Synthetic oligonucleotide"
caggauggggagagggagg

SEQ ID NO: 6220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggauggggagagggaggtt

SEQ ID NO: 6221 - RNA, 19 nt, Artificial Sequence
  source: /note="Description of Artificial Sequence: Synthetic oligonucleotide"
ccucuccccauccuggaag

SEQ ID NO: 6222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuccccauccuggaagtt

SEQ ID NO: 6223 - RNA, 19 nt, Artificial Sequence
  source: /note="Description of Artificial Sequence: Synthetic oligonucleotide"
cuuccaggauggggagagg

SEQ ID NO: 6224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccaggauggggagaggtt

SEQ ID NO: 6225 - RNA, 19 nt, Artificial Sequence
  source: /note="Description of Artificial Sequence: Synthetic oligonucleotide"
cauccuggaaggaggggag

SEQ ID NO: 6226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccuggaaggaggggagtt

SEQ ID NO: 6227 - RNA, 19 nt, Artificial Sequence
  source: /note="Description of Artificial Sequence: Synthetic oligonucleotide"
cuccccuccuuccaggaug

SEQ ID NO: 6228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccuccuuccaggaugtt

SEQ ID NO: 6229 - RNA, 19 nt, Artificial Sequence
  source: /note="Description of Artificial Sequence: Synthetic oligonucleotide"
uagagagagucccuggugu

SEQ ID NO: 6230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagagagagucccuggugutt

SEQ ID NO: 6231 - RNA, 19 nt, Artificial Sequence
  source: /note="Description of Artificial Sequence: Synthetic oligonucleotide"
acaccagggacucucucua

SEQ ID NO: 6232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccagggacucucucuatt

SEQ ID NO: 6233 - RNA, 19 nt, Artificial Sequence
  source: /note="Description of Artificial Sequence: Synthetic oligonucleotide"
ggugucuuaguuuccacag

SEQ ID NO: 6234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugucuuaguuuccacagtt

SEQ ID NO: 6235 - RNA, 19 nt, Artificial Sequence
  source: /note="Description of Artificial Sequence: Synthetic oligonucleotide"
cuguggaaacuaagacacc

SEQ ID NO: 6236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggaaacuaagacacctt

SEQ ID NO: 6237 - RNA, 19 nt, Artificial Sequence
  source: /note="Description of Artificial Sequence: Synthetic oligonucleotide"
uaguuuccacaguaagguu

SEQ ID NO: 6238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguuuccacaguaagguutt

SEQ ID NO: 6239 - RNA, 19 nt, Artificial Sequence
  source: /note="Description of Artificial Sequence: Synthetic oligonucleotide"
aaccuuacuguggaaacua

SEQ ID NO: 6240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccuuacuguggaaacuatt

SEQ ID NO: 6241 - RNA, 19 nt, Artificial Sequence
  source: /note="Description of Artificial Sequence: Synthetic oligonucleotide"
auuauuggcaugaaacccu

SEQ ID NO: 6242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuauuggcaugaaacccutt

SEQ ID NO: 6243 - RNA, 19 nt, Artificial Sequence
  source: /note="Description of Artificial Sequence: Synthetic oligonucleotide"
aggguuucaugccaauaau

SEQ ID NO: 6244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggguuucaugccaauaautt

SEQ ID NO: 6245 - RNA, 19 nt, Artificial Sequence
  source: /note="Description of Artificial Sequence: Synthetic oligonucleotide"
cugggccggagccggagcc

SEQ ID NO: 6246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccggagccggagcctt

SEQ ID NO: 6247 - RNA, 19 nt, Artificial Sequence
  source: /note="Description of Artificial Sequence: Synthetic oligonucleotide"
ggcuccggcuccggcccag

SEQ ID NO: 6248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccggcuccggcccagtt

SEQ ID NO: 6249 - RNA, 19 nt, Artificial Sequence
  source: /note="Description of Artificial Sequence: Synthetic oligonucleotide"
gcggcggcagaggcagcgg

SEQ ID NO: 6250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggcggcagaggcagcggtt

SEQ ID NO: 6251 - RNA, 19 nt, Artificial Sequence
  source: /note="Description of Artificial Sequence: Synthetic oligonucleotide"
ccgcugccucugccgccgc

SEQ ID NO: 6252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcugccucugccgccgctt

SEQ ID NO: 6253 - RNA, 19 nt, Artificial Sequence
  source: /note="Description of Artificial Sequence: Synthetic oligonucleotide"
cggcggcagaggcagcggc

SEQ ID NO: 6254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcggcagaggcagcggctt

SEQ ID NO: 6255 - RNA, 19 nt, Artificial Sequence
  source: /note="Description of Artificial Sequence: Synthetic oligonucleotide"
gccgcugccucugccgccg

SEQ ID NO: 6256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgcugccucugccgccgtt

SEQ ID NO: 6257 - RNA, 19 nt, Artificial Sequence
  source: /note="Description of Artificial Sequence: Synthetic oligonucleotide"
cagaggcagcggcgggggc

SEQ ID NO: 6258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaggcagcggcgggggctt

SEQ ID NO: 6259 - RNA, 19 nt, Artificial Sequence
  source: /note="Description of Artificial Sequence: Synthetic oligonucleotide"
gcccccgccgcugccucug

SEQ ID NO: 6260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccgccgcugccucugtt

SEQ ID NO: 6261 - RNA, 19 nt, Artificial Sequence
  source: /note="Description of Artificial Sequence: Synthetic oligonucleotide"
gggcagcccaggcagcccg

SEQ ID NO: 6262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcagcccaggcagcccgtt

SEQ ID NO: 6263 - RNA, 19 nt, Artificial Sequence
  source: /note="Description of Artificial Sequence: Synthetic oligonucleotide"
cgggcugccugggcugccc

SEQ ID NO: 6264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcugccugggcugccctt

SEQ ID NO: 6265 - RNA, 19 nt, Artificial Sequence
  source: /note="Description of Artificial Sequence: Synthetic oligonucleotide"
ggaggcggaggcggaggug

SEQ ID NO: 6266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcggaggcggaggugtt

SEQ ID NO: 6267 - RNA, 19 nt, Artificial Sequence
  source: /note="Description of Artificial Sequence: Synthetic oligonucleotide"
caccuccgccuccgccucc

SEQ ID NO: 6268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuccgccuccgccucctt

SEQ ID NO: 6269 - RNA, 19 nt, Artificial Sequence
  source: /note="Description of Artificial Sequence: Synthetic oligonucleotide"
gaggcggaggcggaggugg

SEQ ID NO: 6270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcggaggcggagguggtt

SEQ ID NO: 6271 - RNA, 19 nt, Artificial Sequence
  source: /note="Description of Artificial Sequence: Synthetic oligonucleotide"
ccaccuccgccuccgccuc

SEQ ID NO: 6272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccuccgccuccgccuctt

SEQ ID NO: 6273 - RNA, 19 nt, Artificial Sequence
  source: /note="Description of Artificial Sequence: Synthetic oligonucleotide"
gcggaggcggagguggugg

SEQ ID NO: 6274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggaggcggaggugguggtt

SEQ ID NO: 6275 - RNA, 19 nt, Artificial Sequence
  source: /note="Description of Artificial Sequence: Synthetic oligonucleotide"
ccaccaccuccgccuccgc

SEQ ID NO: 6276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccaccuccgccuccgctt

SEQ ID NO: 6277 - RNA, 19 nt, Artificial Sequence
  source: /note="Description of Artificial Sequence: Synthetic oligonucleotide"
ugguggcggcggccccggg

SEQ ID NO: 6278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguggcggcggccccgggtt

SEQ ID NO: 6279 - RNA, 19 nt, Artificial Sequence
  source: /note="Description of Artificial Sequence: Synthetic oligonucleotide"
cccggggccgccgccacca

SEQ ID NO: 6280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggggccgccgccaccatt

SEQ ID NO: 6281 - RNA, 19 nt, Artificial Sequence
  source: /note="Description of Artificial Sequence: Synthetic oligonucleotide"
uaccaggcacggcuggcag

SEQ ID NO: 6282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccaggcacggcuggcagtt

SEQ ID NO: 6283 - RNA, 19 nt, Artificial Sequence
  source: /note="Description of Artificial Sequence: Synthetic oligonucleotide"
cugccagccgugccuggua

SEQ ID NO: 6284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccagccgugccugguatt

SEQ ID NO: 6285 - RNA, 19 nt, Artificial Sequence
  source: /note="Description of Artificial Sequence: Synthetic oligonucleotide"
cuucucggccagcccaucu

SEQ ID NO: 6286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucucggccagcccaucutt

SEQ ID NO: 6287 - RNA, 19 nt, Artificial Sequence
  source: /note="Description of Artificial Sequence: Synthetic oligonucleotide"
agaugggcuggccgagaag

SEQ ID NO: 6288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugggcuggccgagaagtt

SEQ ID NO: 6289 - RNA, 19 nt, Artificial Sequence
  source: /note="Description of Artificial Sequence: Synthetic oligonucleotide"
ucuucaaagacaccaccug

SEQ ID NO: 6290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucaaagacaccaccugtt

SEQ ID NO: 6291 - RNA, 19 nt, Artificial Sequence
  source: /note="Description of Artificial Sequence: Synthetic oligonucleotide"
cagguggugucuuugaaga

SEQ ID NO: 6292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagguggugucuuugaagatt

SEQ ID NO: 6293 - RNA, 19 nt, Artificial Sequence
  source: /note="Description of Artificial Sequence: Synthetic oligonucleotide"
ucaccacuuccuacaaccc

SEQ ID NO: 6294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccacuuccuacaaccctt

SEQ ID NO: 6295 - RNA, 19 nt, Artificial Sequence
  source: /note="Description of Artificial Sequence: Synthetic oligonucleotide"
ggguuguaggaagugguga

SEQ ID NO: 6296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguuguaggaaguggugatt

SEQ ID NO: 6297 - RNA, 19 nt, Artificial Sequence
  source: /note="Description of Artificial Sequence: Synthetic oligonucleotide"
ccccuccccucccccaggc

SEQ ID NO: 6298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuccccucccccaggctt

SEQ ID NO: 6299 - RNA, 19 nt, Artificial Sequence
  source: /note="Description of Artificial Sequence: Synthetic oligonucleotide"
gccugggggaggggagggg

SEQ ID NO: 6300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugggggaggggaggggtt

SEQ ID NO: 6301 - RNA, 19 nt, Artificial Sequence
  source: /note="Description of Artificial Sequence: Synthetic oligonucleotide"
cccuccccucccccaggcu

SEQ ID NO: 6302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuccccucccccaggcutt

SEQ ID NO: 6303 - RNA, 19 nt, Artificial Sequence
  source: /note="Description of Artificial Sequence: Synthetic oligonucleotide"
agccugggggaggggaggg

SEQ ID NO: 6304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccugggggaggggagggtt

SEQ ID NO: 6305 - RNA, 19 nt, Artificial Sequence
  source: /note="Description of Artificial Sequence: Synthetic oligonucleotide"
accccuucuuguccucugc

SEQ ID NO: 6306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accccuucuuguccucugctt

SEQ ID NO: 6307 - RNA, 19 nt, Artificial Sequence
  source: /note="Description of Artificial Sequence: Synthetic oligonucleotide"
gcagaggacaagaaggggu

SEQ ID NO: 6308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagaggacaagaaggggutt

SEQ ID NO: 6309 - RNA, 19 nt, Artificial Sequence
  source: /note="Description of Artificial Sequence: Synthetic oligonucleotide"
cucccucuccccauccugg

SEQ ID NO: 6310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccucuccccauccuggtt

SEQ ID NO: 6311 - RNA, 19 nt, Artificial Sequence
  source: /note="Description of Artificial Sequence: Synthetic oligonucleotide"
ccaggauggggagagggag

SEQ ID NO: 6312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggauggggagagggagtt

SEQ ID NO: 6313 - RNA, 19 nt, Artificial Sequence
  source: /note="Description of Artificial Sequence: Synthetic oligonucleotide"
cccucuccccauccuggaa

SEQ ID NO: 6314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucuccccauccuggaatt

SEQ ID NO: 6315 - RNA, 19 nt, Artificial Sequence
  source: /note="Description of Artificial Sequence: Synthetic oligonucleotide"
uuccaggauggggagaggg

SEQ ID NO: 6316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaggauggggagagggtt

SEQ ID NO: 6317 - RNA, 19 nt, Artificial Sequence
  source: /note="Description of Artificial Sequence: Synthetic oligonucleotide"
caccgacuaccccuccacg

SEQ ID NO: 6318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccgacuaccccuccacgtt

SEQ ID NO: 6319 - RNA, 19 nt, Artificial Sequence
  source: /note="Description of Artificial Sequence: Synthetic oligonucleotide"
cguggagggguagucggug

SEQ ID NO: 6320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguggagggguagucggugtt

SEQ ID NO: 6321 - RNA, 19 nt, Artificial Sequence
  source: /note="Description of Artificial Sequence: Synthetic oligonucleotide"
ccgacuaccccuccacguc

SEQ ID NO: 6322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgacuaccccuccacguctt

SEQ ID NO: 6323 - RNA, 19 nt, Artificial Sequence
  source: /note="Description of Artificial Sequence: Synthetic oligonucleotide"
gacguggagggguagucgg

SEQ ID NO: 6324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacguggagggguagucggtt

SEQ ID NO: 6325 - RNA, 19 nt, Artificial Sequence
  source: /note="Description of Artificial Sequence: Synthetic oligonucleotide"
cucgguacuaccgugcucc

SEQ ID NO: 6326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgguacuaccgugcucctt

SEQ ID NO: 6327 - RNA, 19 nt, Artificial Sequence
  source: /note="Description of Artificial Sequence: Synthetic oligonucleotide"
ggagcacgguaguaccgag

SEQ ID NO: 6328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcacgguaguaccgagtt

SEQ ID NO: 6329 - RNA, 19 nt, Artificial Sequence
  source: /note="Description of Artificial Sequence: Synthetic oligonucleotide"
ucucgguacuaccgugcuc

SEQ ID NO: 6330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgguacuaccgugcuctt

SEQ ID NO: 6331 - RNA, 19 nt, Artificial Sequence
  source: /note="Description of Artificial Sequence: Synthetic oligonucleotide"
gagcacgguaguaccgaga

SEQ ID NO: 6332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcacgguaguaccgagatt

SEQ ID NO: 6333 - RNA, 19 nt, Artificial Sequence
  source: /note="Description of Artificial Sequence: Synthetic oligonucleotide"
acuaccgugcuccagaacu

SEQ ID NO: 6334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuaccgugcuccagaacutt

SEQ ID NO: 6335 - RNA, 19 nt, Artificial Sequence
  source: /note="Description of Artificial Sequence: Synthetic oligonucleotide"
aguucuggagcacgguagu

SEQ ID NO: 6336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucuggagcacgguagutt

SEQ ID NO: 6337 - RNA, 19 nt, Artificial Sequence
  source: /note="Description of Artificial Sequence: Synthetic oligonucleotide"
cgacuaccccuccacgucc

SEQ ID NO: 6338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacuaccccuccacgucctt

SEQ ID NO: 6339 - RNA, 19 nt, Artificial Sequence
  source: /note="Description of Artificial Sequence: Synthetic oligonucleotide"
ggacguggagggguagucg

SEQ ID NO: 6340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacguggagggguagucgtt

SEQ ID NO: 6341 - RNA, 19 nt, Artificial Sequence
  source: /note="Description of Artificial Sequence: Synthetic oligonucleotide"
aacuacccccagcaucuag

SEQ ID NO: 6342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuacccccagcaucuagtt

SEQ ID NO: 6343 - RNA, 19 nt, Artificial Sequence
  source: /note="Description of Artificial Sequence: Synthetic oligonucleotide"
cuagaugcuggggguaguu

SEQ ID NO: 6344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagaugcuggggguaguutt

SEQ ID NO: 6345 - RNA, 19 nt, Artificial Sequence
  source: /note="Description of Artificial Sequence: Synthetic oligonucleotide"
cucucgguacuaccgugcu

SEQ ID NO: 6346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucgguacuaccgugcutt

SEQ ID NO: 6347 - RNA, 19 nt, Artificial Sequence
  source: /note="Description of Artificial Sequence: Synthetic oligonucleotide"
agcacgguaguaccgagag

SEQ ID NO: 6348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcacgguaguaccgagagtt

SEQ ID NO: 6349 - RNA, 19 nt, Artificial Sequence
  source: /note="Description of Artificial Sequence: Synthetic oligonucleotide"
aacgccaaccagggaacaa

SEQ ID NO: 6350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacgccaaccagggaacaatt

SEQ ID NO: 6351 - RNA, 19 nt, Artificial Sequence
  source: /note="Description of Artificial Sequence: Synthetic oligonucleotide"
uuguucccugguuggcguu

SEQ ID NO: 6352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguucccugguuggcguutt

SEQ ID NO: 6353 - RNA, 19 nt, Artificial Sequence
  source: /note="Description of Artificial Sequence: Synthetic oligonucleotide"
ggaguaugugcccgagacg

SEQ ID NO: 6354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguaugugcccgagacgtt

SEQ ID NO: 6355 - RNA, 19 nt, Artificial Sequence
  source: /note="Description of Artificial Sequence: Synthetic oligonucleotide"
cgucucgggcacauacucc

SEQ ID NO: 6356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucucgggcacauacucctt

SEQ ID NO: 6357 - RNA, 19 nt, Artificial Sequence
  source: /note="Description of Artificial Sequence: Synthetic oligonucleotide"
guaugugcccgagacggug

SEQ ID NO: 6358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaugugcccgagacggugtt

SEQ ID NO: 6359 - RNA, 19 nt, Artificial Sequence
  source: /note="Description of Artificial Sequence: Synthetic oligonucleotide"
caccgucucgggcacauac

SEQ ID NO: 6360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccgucucgggcacauactt

SEQ ID NO: 6361 - RNA, 19 nt, Artificial Sequence
  source: /note="Description of Artificial Sequence: Synthetic oligonucleotide"
uaugugcccgagacggugu

SEQ ID NO: 6362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaugugcccgagacggugutt

SEQ ID NO: 6363 - RNA, 19 nt, Artificial Sequence
  source: /note="Description of Artificial Sequence: Synthetic oligonucleotide"
acaccgucucgggcacaua

SEQ ID NO: 6364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccgucucgggcacauatt

SEQ ID NO: 6365 - RNA, 19 nt, Artificial Sequence
  source: /note="Description of Artificial Sequence: Synthetic oligonucleotide"
ucugcgauuuuggcagugc

SEQ ID NO: 6366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcgauuuuggcagugctt

SEQ ID NO: 6367 - RNA, 19 nt, Artificial Sequence
  source: /note="Description of Artificial Sequence: Synthetic oligonucleotide"
gcacugccaaaaucgcaga

SEQ ID NO: 6368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacugccaaaaucgcagatt

SEQ ID NO: 6369 - RNA, 19 nt, Artificial Sequence
  source: /note="Description of Artificial Sequence: Synthetic oligonucleotide"
cgguacuaccgugcuccag

SEQ ID NO: 6370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguacuaccgugcuccagtt

SEQ ID NO: 6371 - RNA, 19 nt, Artificial Sequence
  source: /note="Description of Artificial Sequence: Synthetic oligonucleotide"
cuggagcacgguaguaccg

SEQ ID NO: 6372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggagcacgguaguaccgtt

SEQ ID NO: 6373 - RNA, 19 nt, Artificial Sequence
  source: /note="Description of Artificial Sequence: Synthetic oligonucleotide"
uacuaccgugcuccagaac

SEQ ID NO: 6374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuaccgugcuccagaactt

SEQ ID NO: 6375 - RNA, 19 nt, Artificial Sequence
  source: /note="Description of Artificial Sequence: Synthetic oligonucleotide"
guucuggagcacgguagua

SEQ ID NO: 6376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuggagcacgguaguatt

SEQ ID NO: 6377 - RNA, 19 nt, Artificial Sequence
  source: /note="Description of Artificial Sequence: Synthetic oligonucleotide"
cuaccgugcuccagaacuc

SEQ ID NO: 6378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccgugcuccagaacuctt

SEQ ID NO: 6379 - RNA, 19 nt, Artificial Sequence
  source: /note="Description of Artificial Sequence: Synthetic oligonucleotide"
gaguucuggagcacgguag

SEQ ID NO: 6380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguucuggagcacgguagtt

SEQ ID NO: 6381 - RNA, 19 nt, Artificial Sequence
  source: /note="Description of Artificial Sequence: Synthetic oligonucleotide"
ucaagguacuaggaacgcc

SEQ ID NO: 6382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagguacuaggaacgcctt

SEQ ID NO: 6383 - RNA, 19 nt, Artificial Sequence
  source: /note="Description of Artificial Sequence: Synthetic oligonucleotide"
ggcguuccuaguaccuuga

SEQ ID NO: 6384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcguuccuaguaccuugatt

SEQ ID NO: 6385 - RNA, 19 nt, Artificial Sequence
  source: /note="Description of Artificial Sequence: Synthetic oligonucleotide"
caagguacuaggaacgcca

SEQ ID NO: 6386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagguacuaggaacgccatt

SEQ ID NO: 6387 - RNA, 19 nt, Artificial Sequence
  source: /note="Description of Artificial Sequence: Synthetic oligonucleotide"
uggcguuccuaguaccuug

SEQ ID NO: 6388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcguuccuaguaccuugtt

SEQ ID NO: 6389 - RNA, 19 nt, Artificial Sequence
  source: /note="Description of Artificial Sequence: Synthetic oligonucleotide"
aagguacuaggaacgccaa

SEQ ID NO: 6390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguacuaggaacgccaatt

SEQ ID NO: 6391 - RNA, 19 nt, Artificial Sequence
  source: /note="Description of Artificial Sequence: Synthetic oligonucleotide"
uuggcguuccuaguaccuu

SEQ ID NO: 6392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcguuccuaguaccuutt

SEQ ID NO: 6393 - RNA, 19 nt, Artificial Sequence
  source: /note="Description of Artificial Sequence: Synthetic oligonucleotide"
agguacuaggaacgccaac

SEQ ID NO: 6394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguacuaggaacgccaactt

SEQ ID NO: 6395 - RNA, 19 nt, Artificial Sequence
  source: /note="Description of Artificial Sequence: Synthetic oligonucleotide"
guuggcguuccuaguaccu

SEQ ID NO: 6396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuggcguuccuaguaccutt

SEQ ID NO: 6397 - RNA, 19 nt, Artificial Sequence
  source: /note="Description of Artificial Sequence: Synthetic oligonucleotide"
cuaggaacgccaaccaggg

SEQ ID NO: 6398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggaacgccaaccagggtt

SEQ ID NO: 6399 - RNA, 19 nt, Artificial Sequence
  source: /note="Description of Artificial Sequence: Synthetic oligonucleotide"
cccugguuggcguuccuag

SEQ ID NO: 6400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugguuggcguuccuagtt

SEQ ID NO: 6401 - RNA, 19 nt, Artificial Sequence
  source: /note="Description of Artificial Sequence: Synthetic oligonucleotide"
acgccaaccagggaacaaa

SEQ ID NO: 6402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgccaaccagggaacaaatt

SEQ ID NO: 6403 - RNA, 19 nt, Artificial Sequence
  source: /note="Description of Artificial Sequence: Synthetic oligonucleotide"
uuuguucccugguuggcgu

SEQ ID NO: 6404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuguucccugguuggcgutt

SEQ ID NO: 6405 - RNA, 19 nt, Artificial Sequence
  source: /note="Description of Artificial Sequence: Synthetic oligonucleotide"
ccaccgacuaccccuccac

SEQ ID NO: 6406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccgacuaccccuccactt

SEQ ID NO: 6407 - RNA, 19 nt, Artificial Sequence
  source: /note="Description of Artificial Sequence: Synthetic oligonucleotide"
guggagggguagucggugg

SEQ ID NO: 6408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggagggguagucgguggtt

SEQ ID NO: 6409 - RNA, 19 nt, Artificial Sequence
  source: /note="Description of Artificial Sequence: Synthetic oligonucleotide"
accgacuaccccuccacgu

SEQ ID NO: 6410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgacuaccccuccacgutt

SEQ ID NO: 6411 - RNA, 19 nt, Artificial Sequence
  source: /note="Description of Artificial Sequence: Synthetic oligonucleotide"
acguggagggguagucggu

SEQ ID NO: 6412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acguggagggguagucggutt

SEQ ID NO: 6413 - RNA, 19 nt, Artificial Sequence
  source: /note="Description of Artificial Sequence: Synthetic oligonucleotide"
guaaaugaacuacccccag

SEQ ID NO: 6414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaaugaacuacccccagtt

SEQ ID NO: 6415 - RNA, 19 nt, Artificial Sequence
  source: /note="Description of Artificial Sequence: Synthetic oligonucleotide"
cuggggguaguucauuuac

SEQ ID NO: 6416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggguaguucauuuactt

SEQ ID NO: 6417 - RNA, 19 nt, Artificial Sequence
  source: /note="Description of Artificial Sequence: Synthetic oligonucleotide"
gaacuacccccagcaucua

SEQ ID NO: 6418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuacccccagcaucuatt

SEQ ID NO: 6419 - RNA, 19 nt, Artificial Sequence
  source: /note="Description of Artificial Sequence: Synthetic oligonucleotide"
uagaugcuggggguaguuc

SEQ ID NO: 6420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaugcuggggguaguuctt

SEQ ID NO: 6421 - RNA, 19 nt, Artificial Sequence
  source: /note="Description of Artificial Sequence: Synthetic oligonucleotide"
gggcuaugggugggggcgu

SEQ ID NO: 6422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuaugggugggggcgutt

SEQ ID NO: 6423 - RNA, 19 nt, Artificial Sequence
  source: /note="Description of Artificial Sequence: Synthetic oligonucleotide"
acgcccccacccauagccc

SEQ ID NO: 6424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgcccccacccauagccctt

SEQ ID NO: 6425 - RNA, 19 nt, Artificial Sequence
  source: /note="Description of Artificial Sequence: Synthetic oligonucleotide"
gcuaugggugggggcgugg

SEQ ID NO: 6426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaugggugggggcguggtt

SEQ ID NO: 6427 - RNA, 19 nt, Artificial Sequence
  source: /note="Description of Artificial Sequence: Synthetic oligonucleotide"
ccacgcccccacccauagc

SEQ ID NO: 6428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacgcccccacccauagctt

SEQ ID NO: 6429 - RNA, 19 nt, Artificial Sequence
  source: /note="Description of Artificial Sequence: Synthetic oligonucleotide"
cccagagcguucccaagaa

SEQ ID NO: 6430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagagcguucccaagaatt

SEQ ID NO: 6431 - RNA, 19 nt, Artificial Sequence
  source: /note="Description of Artificial Sequence: Synthetic oligonucleotide"
uucuugggaacgcucuggg

SEQ ID NO: 6432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuugggaacgcucugggtt

SEQ ID NO: 6433 - RNA, 19 nt, Artificial Sequence
  source: /note="Description of Artificial Sequence: Synthetic oligonucleotide"
cagagcguucccaagaagu

SEQ ID NO: 6434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagcguucccaagaagutt

SEQ ID NO: 6435 - RNA, 19 nt, Artificial Sequence
  source: /note="Description of Artificial Sequence: Synthetic oligonucleotide"
acuucuugggaacgcucug

SEQ ID NO: 6436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucuugggaacgcucugtt

SEQ ID NO: 6437 - RNA, 19 nt, Artificial Sequence
  source: /note="Description of Artificial Sequence: Synthetic oligonucleotide"
agagcguucccaagaagug

SEQ ID NO: 6438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcguucccaagaagugtt

SEQ ID NO: 6439 - RNA, 19 nt, Artificial Sequence
  source: /note="Description of Artificial Sequence: Synthetic oligonucleotide"
cacuucuugggaacgcucu

SEQ ID NO: 6440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuucuugggaacgcucutt

SEQ ID NO: 6441 - RNA, 19 nt, Artificial Sequence
  source: /note="Description of Artificial Sequence: Synthetic oligonucleotide"
gcguucccaagaaguggcu

SEQ ID NO: 6442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcguucccaagaaguggcutt

SEQ ID NO: 6443 - RNA, 19 nt, Artificial Sequence
  source: /note="Description of Artificial Sequence: Synthetic oligonucleotide"
agccacuucuugggaacgc

SEQ ID NO: 6444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccacuucuugggaacgctt

SEQ ID NO: 6445 - RNA, 19 nt, Artificial Sequence
  source: /note="Description of Artificial Sequence: Synthetic oligonucleotide"
cugacaucaaagugauugg

SEQ ID NO: 6446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacaucaaagugauuggtt

SEQ ID NO: 6447 - RNA, 19 nt, Artificial Sequence
  source: /note="Description of Artificial Sequence: Synthetic oligonucleotide"
ccaaucacuuugaugucag

SEQ ID NO: 6448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaucacuuugaugucagtt

SEQ ID NO: 6449 - RNA, 19 nt, Artificial Sequence
  source: /note="Description of Artificial Sequence: Synthetic oligonucleotide"
guaauggcucauucggagu

SEQ ID NO: 6450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaauggcucauucggagutt

SEQ ID NO: 6451 - RNA, 19 nt, Artificial Sequence
  source: /note="Description of Artificial Sequence: Synthetic oligonucleotide"
acuccgaaugagccauuac

SEQ ID NO: 6452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccgaaugagccauuactt

SEQ ID NO: 6453 - RNA, 19 nt, Artificial Sequence
  source: /note="Description of Artificial Sequence: Synthetic oligonucleotide"
uaauggcucauucggagua

SEQ ID NO: 6454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauggcucauucggaguatt

SEQ ID NO: 6455 - RNA, 19 nt, Artificial Sequence
  source: /note="Description of Artificial Sequence: Synthetic oligonucleotide"
uacuccgaaugagccauua

SEQ ID NO: 6456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccgaaugagccauuatt

SEQ ID NO: 6457 - RNA, 19 nt, Artificial Sequence
  source: /note="Description of Artificial Sequence: Synthetic oligonucleotide"
aauggcucauucggaguag

SEQ ID NO: 6458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggcucauucggaguagtt

SEQ ID NO: 6459 - RNA, 19 nt, Artificial Sequence
  source: /note="Description of Artificial Sequence: Synthetic oligonucleotide"
cuacuccgaaugagccauu

SEQ ID NO: 6460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacuccgaaugagccauutt

SEQ ID NO: 6461 - RNA, 19 nt, Artificial Sequence
  source: /note="Description of Artificial Sequence: Synthetic oligonucleotide"
uggcucauucggaguagua

SEQ ID NO: 6462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcucauucggaguaguatt

SEQ ID NO: 6463 - RNA, 19 nt, Artificial Sequence
  source: /note="Description of Artificial Sequence: Synthetic oligonucleotide"
uacuacuccgaaugagcca

SEQ ID NO: 6464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuacuccgaaugagccatt

SEQ ID NO: 6465 - RNA, 19 nt, Artificial Sequence
  source: /note="Description of Artificial Sequence: Synthetic oligonucleotide"
ggccaucaagaagguucuu

SEQ ID NO: 6466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaucaagaagguucuutt

SEQ ID NO: 6467 - RNA, 19 nt, Artificial Sequence
  source: /note="Description of Artificial Sequence: Synthetic oligonucleotide"
aagaaccuucuugauggcc

SEQ ID NO: 6468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaccuucuugauggcctt

SEQ ID NO: 6469 - RNA, 19 nt, Artificial Sequence
  source: /note="Description of Artificial Sequence: Synthetic oligonucleotide"
agcuggaccacugcaauau

SEQ ID NO: 6470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuggaccacugcaauautt

SEQ ID NO: 6471 - RNA, 19 nt, Artificial Sequence
  source: /note="Description of Artificial Sequence: Synthetic oligonucleotide"
auauugcagugguccagcu

SEQ ID NO: 6472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauugcagugguccagcutt

SEQ ID NO: 6473 - RNA, 19 nt, Artificial Sequence
  source: /note="Description of Artificial Sequence: Synthetic oligonucleotide"
gaccacugcaauauuguga

SEQ ID NO: 6474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccacugcaauauugugatt

SEQ ID NO: 6475 - RNA, 19 nt, Artificial Sequence
  source: /note="Description of Artificial Sequence: Synthetic oligonucleotide"
ucacaauauugcagugguc

SEQ ID NO: 6476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacaauauugcagugguctt

SEQ ID NO: 6477 - RNA, 19 nt, Artificial Sequence
  source: /note="Description of Artificial Sequence: Synthetic oligonucleotide"
acugcaauauugugaggcu

SEQ ID NO: 6478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcaauauugugaggcutt

SEQ ID NO: 6479 - RNA, 19 nt, Artificial Sequence
  source: /note="Description of Artificial Sequence: Synthetic oligonucleotide"
agccucacaauauugcagu

SEQ ID NO: 6480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccucacaauauugcagutt

SEQ ID NO: 6481 - RNA, 19 nt, Artificial Sequence
  source: /note="Description of Artificial Sequence: Synthetic oligonucleotide"
uuuucuacuccagugggga

SEQ ID NO: 6482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuucuacuccaguggggatt

SEQ ID NO: 6483 - RNA, 19 nt, Artificial Sequence
  source: /note="Description of Artificial Sequence: Synthetic oligonucleotide"
uccccacuggaguagaaaa

SEQ ID NO: 6484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccacuggaguagaaaatt

SEQ ID NO: 6485 - RNA, 19 nt, Artificial Sequence
  source: /note="Description of Artificial Sequence: Synthetic oligonucleotide"
uuucuacuccaguggggag

SEQ ID NO: 6486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuacuccaguggggagtt

SEQ ID NO: 6487 - RNA, 19 nt, Artificial Sequence
  source: /note="Description of Artificial Sequence: Synthetic oligonucleotide"
cuccccacuggaguagaaa

SEQ ID NO: 6488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccccacuggaguagaaatt

SEQ ID NO: 6489 - RNA, 19 nt, Artificial Sequence
  source: /note="Description of Artificial Sequence: Synthetic oligonucleotide"
uucuacuccaguggggaga

SEQ ID NO: 6490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuacuccaguggggagatt

SEQ ID NO: 6491 - RNA, 19 nt, Artificial Sequence
  source: /note="Description of Artificial Sequence: Synthetic oligonucleotide"
ucuccccacuggaguagaa

SEQ ID NO: 6492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccccacuggaguagaatt

SEQ ID NO: 6493 - RNA, 19 nt, Artificial Sequence
  source: /note="Description of Artificial Sequence: Synthetic oligonucleotide"
ucuacuccaguggggagaa

SEQ ID NO: 6494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacuccaguggggagaatt

SEQ ID NO: 6495 - RNA, 19 nt, Artificial Sequence
  source: /note="Description of Artificial Sequence: Synthetic oligonucleotide"
uucuccccacuggaguaga

SEQ ID NO: 6496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuccccacuggaguagatt

SEQ ID NO: 6497 - RNA, 19 nt, Artificial Sequence
  source: /note="Description of Artificial Sequence: Synthetic oligonucleotide"
uguauuugaaucuggugcu

SEQ ID NO: 6498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauuugaaucuggugcutt

SEQ ID NO: 6499 - RNA, 19 nt, Artificial Sequence
  source: /note="Description of Artificial Sequence: Synthetic oligonucleotide"
agcaccagauucaaauaca

SEQ ID NO: 6500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaccagauucaaauacatt

SEQ ID NO: 6501 - RNA, 19 nt, Artificial Sequence
  source: /note="Description of Artificial Sequence: Synthetic oligonucleotide"
uauuugaaucuggugcugg

SEQ ID NO: 6502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuugaaucuggugcuggtt

SEQ ID NO: 6503 - RNA, 19 nt, Artificial Sequence
  source: /note="Description of Artificial Sequence: Synthetic oligonucleotide"
ccagcaccagauucaaaua

SEQ ID NO: 6504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcaccagauucaaauatt

SEQ ID NO: 6505 - RNA, 19 nt, Artificial Sequence
  source: /note="Description of Artificial Sequence: Synthetic oligonucleotide"
auuugaaucuggugcugga

SEQ ID NO: 6506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugaaucuggugcuggatt

SEQ ID NO: 6507 - RNA, 19 nt, Artificial Sequence
  source: /note="Description of Artificial Sequence: Synthetic oligonucleotide"
uccagcaccagauucaaau

SEQ ID NO: 6508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagcaccagauucaaautt

SEQ ID NO: 6509 - RNA, 19 nt, Artificial Sequence
  source: /note="Description of Artificial Sequence: Synthetic oligonucleotide"
uugaaucuggugcuggagu

SEQ ID NO: 6510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaaucuggugcuggagutt

SEQ ID NO: 6511 - RNA, 19 nt, Artificial Sequence
  source: /note="Description of Artificial Sequence: Synthetic oligonucleotide"
acuccagcaccagauucaa

SEQ ID NO: 6512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccagcaccagauucaatt

SEQ ID NO: 6513 - RNA, 19 nt, Artificial Sequence
  source: /note="Description of Artificial Sequence: Synthetic oligonucleotide"
ugaaucuggugcuggagua

SEQ ID NO: 6514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaucuggugcuggaguatt

SEQ ID NO: 6515 - RNA, 19 nt, Artificial Sequence
  source: /note="Description of Artificial Sequence: Synthetic oligonucleotide"
uacuccagcaccagauuca

SEQ ID NO: 6516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccagcaccagauucatt

SEQ ID NO: 6517 - RNA, 19 nt, Artificial Sequence
  source: /note="Description of Artificial Sequence: Synthetic oligonucleotide"
uggaguaugugcccgagac

SEQ ID NO: 6518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaguaugugcccgagactt

SEQ ID NO: 6519 - RNA, 19 nt, Artificial Sequence
  source: /note="Description of Artificial Sequence: Synthetic oligonucleotide"
gucucgggcacauacucca

SEQ ID NO: 6520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucucgggcacauacuccatt

SEQ ID NO: 6521 - RNA, 19 nt, Artificial Sequence
  source: /note="Description of Artificial Sequence: Synthetic oligonucleotide"
aguaugugcccgagacggu

SEQ ID NO: 6522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaugugcccgagacggutt

SEQ ID NO: 6523 - RNA, 19 nt, Artificial Sequence
  source: /note="Description of Artificial Sequence: Synthetic oligonucleotide"
accgucucgggcacauacu

SEQ ID NO: 6524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgucucgggcacauacutt

SEQ ID NO: 6525 - RNA, 19 nt, Artificial Sequence
  source: /note="Description of Artificial Sequence: Synthetic oligonucleotide"
caagguguacauguaccag

SEQ ID NO: 6526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagguguacauguaccagtt

SEQ ID NO: 6527 - RNA, 19 nt, Artificial Sequence
  source: /note="Description of Artificial Sequence: Synthetic oligonucleotide"
cugguacauguacaccuug

SEQ ID NO: 6528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguacauguacaccuugtt

SEQ ID NO: 6529 - RNA, 19 nt, Artificial Sequence
  source: /note="Description of Artificial Sequence: Synthetic oligonucleotide"
aagguguacauguaccagc

SEQ ID NO: 6530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguguacauguaccagctt

SEQ ID NO: 6531 - RNA, 19 nt, Artificial Sequence
  source: /note="Description of Artificial Sequence: Synthetic oligonucleotide"
gcugguacauguacaccuu

SEQ ID NO: 6532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguacauguacaccuutt

SEQ ID NO: 6533 - RNA, 19 nt, Artificial Sequence
  source: /note="Description of Artificial Sequence: Synthetic oligonucleotide"
agguguacauguaccagcu

SEQ ID NO: 6534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguguacauguaccagcutt

SEQ ID NO: 6535 - RNA, 19 nt, Artificial Sequence
  source: /note="Description of Artificial Sequence: Synthetic oligonucleotide"
agcugguacauguacaccu

SEQ ID NO: 6536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugguacauguacaccutt

SEQ ID NO: 6537 - RNA, 19 nt, Artificial Sequence
  source: /note="Description of Artificial Sequence: Synthetic oligonucleotide"
gguguacauguaccagcuc

SEQ ID NO: 6538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguacauguaccagcuctt

SEQ ID NO: 6539 - RNA, 19 nt, Artificial Sequence
  source: /note="Description of Artificial Sequence: Synthetic oligonucleotide"
gagcugguacauguacacc

SEQ ID NO: 6540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcugguacauguacacctt

SEQ ID NO: 6541 - RNA, 19 nt, Artificial Sequence
  source: /note="Description of Artificial Sequence: Synthetic oligonucleotide"
caccgugacaucaagcccc

SEQ ID NO: 6542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccgugacaucaagcccctt

SEQ ID NO: 6543 - RNA, 19 nt, Artificial Sequence
  source: /note="Description of Artificial Sequence: Synthetic oligonucleotide"
ggggcuugaugucacggug

SEQ ID NO: 6544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcuugaugucacggugtt

SEQ ID NO: 6545 - RNA, 19 nt, Artificial Sequence
  source: /note="Description of Artificial Sequence: Synthetic oligonucleotide"
uuugcuuguggacccugac

SEQ ID NO: 6546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugcuuguggacccugactt

SEQ ID NO: 6547 - RNA, 19 nt, Artificial Sequence
  source: /note="Description of Artificial Sequence: Synthetic oligonucleotide"
gucaggguccacaagcaaa

SEQ ID NO: 6548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaggguccacaagcaaatt

SEQ ID NO: 6549 - RNA, 19 nt, Artificial Sequence
  source: /note="Description of Artificial Sequence: Synthetic oligonucleotide"
guggacccugacacugcug

SEQ ID NO: 6550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggacccugacacugcugtt

SEQ ID NO: 6551 - RNA, 19 nt, Artificial Sequence
  source: /note="Description of Artificial Sequence: Synthetic oligonucleotide"
cagcagugucaggguccac

SEQ ID NO: 6552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcagugucaggguccactt

SEQ ID NO: 6553 - RNA, 19 nt, Artificial Sequence
  source: /note="Description of Artificial Sequence: Synthetic oligonucleotide"
gcucugcgauuuuggcagu

SEQ ID NO: 6554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucugcgauuuuggcagutt

SEQ ID NO: 6555 - RNA, 19 nt, Artificial Sequence
  source: /note="Description of Artificial Sequence: Synthetic oligonucleotide"
acugccaaaaucgcagagc

SEQ ID NO: 6556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugccaaaaucgcagagctt

SEQ ID NO: 6557 - RNA, 19 nt, Artificial Sequence
  source: /note="Description of Artificial Sequence: Synthetic oligonucleotide"
cucugcgauuuuggcagug

SEQ ID NO: 6558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugcgauuuuggcagugtt

SEQ ID NO: 6559 - RNA, 19 nt, Artificial Sequence
  source: /note="Description of Artificial Sequence: Synthetic oligonucleotide"
cacugccaaaaucgcagag

SEQ ID NO: 6560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugccaaaaucgcagagtt

SEQ ID NO: 6561 - RNA, 19 nt, Artificial Sequence
  source: /note="Description of Artificial Sequence: Synthetic oligonucleotide"
ugcgauuuuggcagugcaa

SEQ ID NO: 6562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcgauuuuggcagugcaatt

SEQ ID NO: 6563 - RNA, 19 nt, Artificial Sequence
  source: /note="Description of Artificial Sequence: Synthetic oligonucleotide"
uugcacugccaaaaucgca

SEQ ID NO: 6564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcacugccaaaaucgcatt

SEQ ID NO: 6565 - RNA, 19 nt, Artificial Sequence
  source: /note="Description of Artificial Sequence: Synthetic oligonucleotide"
auuuuggcagugcaaagca

SEQ ID NO: 6566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuuggcagugcaaagcatt

SEQ ID NO: 6567 - RNA, 19 nt, Artificial Sequence
  source: /note="Description of Artificial Sequence: Synthetic oligonucleotide"
ugcuuugcacugccaaaau

SEQ ID NO: 6568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuuugcacugccaaaautt

SEQ ID NO: 6569 - RNA, 19 nt, Artificial Sequence
  source: /note="Description of Artificial Sequence: Synthetic oligonucleotide"
ucgguacuaccgugcucca

SEQ ID NO: 6570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguacuaccgugcuccatt

SEQ ID NO: 6571 - RNA, 19 nt, Artificial Sequence
  source: /note="Description of Artificial Sequence: Synthetic oligonucleotide"
uggagcacgguaguaccga

SEQ ID NO: 6572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagcacgguaguaccgatt

SEQ ID NO: 6573 - RNA, 19 nt, Artificial Sequence
  source: /note="Description of Artificial Sequence: Synthetic oligonucleotide"
guacuaccgugcuccagaa

SEQ ID NO: 6574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuaccgugcuccagaatt

SEQ ID NO: 6575 - RNA, 19 nt, Artificial Sequence
  source: /note="Description of Artificial Sequence: Synthetic oligonucleotide"
uucuggagcacgguaguac

SEQ ID NO: 6576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuggagcacgguaguactt

SEQ ID NO: 6577 - RNA, 19 nt, Artificial Sequence
  source: /note="Description of Artificial Sequence: Synthetic oligonucleotide"
ggaccagcuuguggagauc

SEQ ID NO: 6578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccagcuuguggagauctt

SEQ ID NO: 6579 - RNA, 19 nt, Artificial Sequence
  source: /note="Description of Artificial Sequence: Synthetic oligonucleotide"
gaucuccacaagcuggucc

SEQ ID NO: 6580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucuccacaagcuggucctt

SEQ ID NO: 6581 - RNA, 19 nt, Artificial Sequence
  source: /note="Description of Artificial Sequence: Synthetic oligonucleotide"
agcuuguggagaucaucaa

SEQ ID NO: 6582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuguggagaucaucaatt

SEQ ID NO: 6583 - RNA, 19 nt, Artificial Sequence
  source: /note="Description of Artificial Sequence: Synthetic oligonucleotide"
uugaugaucuccacaagcu

SEQ ID NO: 6584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaugaucuccacaagcutt

SEQ ID NO: 6585 - RNA, 19 nt, Artificial Sequence
  source: /note="Description of Artificial Sequence: Synthetic oligonucleotide"
uguggagaucaucaaggua

SEQ ID NO: 6586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggagaucaucaagguatt

SEQ ID NO: 6587 - RNA, 19 nt, Artificial Sequence
  source: /note="Description of Artificial Sequence: Synthetic oligonucleotide"
uaccuugaugaucuccaca

SEQ ID NO: 6588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccuugaugaucuccacatt

SEQ ID NO: 6589 - RNA, 19 nt, Artificial Sequence
  source: /note="Description of Artificial Sequence: Synthetic oligonucleotide"
agaucaucaagguacuagg

SEQ ID NO: 6590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaucaucaagguacuaggtt

SEQ ID NO: 6591 - RNA, 19 nt, Artificial Sequence
  source: /note="Description of Artificial Sequence: Synthetic oligonucleotide"
ccuaguaccuugaugaucu

SEQ ID NO: 6592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaguaccuugaugaucutt

SEQ ID NO: 6593 - RNA, 19 nt, Artificial Sequence
  source: /note="Description of Artificial Sequence: Synthetic oligonucleotide"
gguacuaggaacgccaacc

SEQ ID NO: 6594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacuaggaacgccaacctt

SEQ ID NO: 6595 - RNA, 19 nt, Artificial Sequence
  source: /note="Description of Artificial Sequence: Synthetic oligonucleotide"
gguuggcguuccuaguacc

SEQ ID NO: 6596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuggcguuccuaguacctt

SEQ ID NO: 6597 - RNA, 19 nt, Artificial Sequence
  source: /note="Description of Artificial Sequence: Synthetic oligonucleotide"
guacuaggaacgccaacca

SEQ ID NO: 6598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuaggaacgccaaccatt

SEQ ID NO: 6599 - RNA, 19 nt, Artificial Sequence
  source: /note="Description of Artificial Sequence: Synthetic oligonucleotide"
ugguuggcguuccuaguac

SEQ ID NO: 6600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguuggcguuccuaguactt

SEQ ID NO: 6601 - RNA, 19 nt, Artificial Sequence
  source: /note="Description of Artificial Sequence: Synthetic oligonucleotide"
uacuaggaacgccaaccag

SEQ ID NO: 6602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuaggaacgccaaccagtt

SEQ ID NO: 6603 - RNA, 19 nt, Artificial Sequence
  source: /note="Description of Artificial Sequence: Synthetic oligonucleotide"
cugguuggcguuccuagua

SEQ ID NO: 6604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguuggcguuccuaguatt

SEQ ID NO: 6605 - RNA, 19 nt, Artificial Sequence
  source: /note="Description of Artificial Sequence: Synthetic oligonucleotide"
uaggaacgccaaccaggga

SEQ ID NO: 6606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggaacgccaaccagggatt

SEQ ID NO: 6607 - RNA, 19 nt, Artificial Sequence
  source: /note="Description of Artificial Sequence: Synthetic oligonucleotide"
ucccugguuggcguuccua

SEQ ID NO: 6608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccugguuggcguuccuatt

SEQ ID NO: 6609 - RNA, 19 nt, Artificial Sequence
  source: /note="Description of Artificial Sequence: Synthetic oligonucleotide"
aggaacgccaaccagggaa

SEQ ID NO: 6610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaacgccaaccagggaatt

SEQ ID NO: 6611 - RNA, 19 nt, Artificial Sequence
  source: /note="Description of Artificial Sequence: Synthetic oligonucleotide"
uucccugguuggcguuccu

SEQ ID NO: 6612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccugguuggcguuccutt

SEQ ID NO: 6613 - RNA, 19 nt, Artificial Sequence
  source: /note="Description of Artificial Sequence: Synthetic oligonucleotide"
ggaacgccaaccagggaac

SEQ ID NO: 6614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacgccaaccagggaactt

SEQ ID NO: 6615 - RNA, 19 nt, Artificial Sequence
  source: /note="Description of Artificial Sequence: Synthetic oligonucleotide"
guucccugguuggcguucc

SEQ ID NO: 6616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucccugguuggcguucctt

SEQ ID NO: 6617 - RNA, 19 nt, Artificial Sequence
  source: /note="Description of Artificial Sequence: Synthetic oligonucleotide"
gaacgccaaccagggaaca

SEQ ID NO: 6618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacgccaaccagggaacatt

SEQ ID NO: 6619 - RNA, 19 nt, Artificial Sequence
  source: /note="Description of Artificial Sequence: Synthetic oligonucleotide"
uguucccugguuggcguuc

SEQ ID NO: 6620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucccugguuggcguuctt

SEQ ID NO: 6621 - RNA, 19 nt, Artificial Sequence
  source: /note="Description of Artificial Sequence: Synthetic oligonucleotide"
ccaaccagggaacaaaucc

SEQ ID NO: 6622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaccagggaacaaaucctt

SEQ ID NO: 6623 - RNA, 19 nt, Artificial Sequence
  source: /note="Description of Artificial Sequence: Synthetic oligonucleotide"
ggauuuguucccugguugg

SEQ ID NO: 6624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauuuguucccugguuggtt

SEQ ID NO: 6625 - RNA, 19 nt, Artificial Sequence
  source: /note="Description of Artificial Sequence: Synthetic oligonucleotide"
aaccagggaacaaauccga

SEQ ID NO: 6626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccagggaacaaauccgatt

SEQ ID NO: 6627 - RNA, 19 nt, Artificial Sequence
  source: /note="Description of Artificial Sequence: Synthetic oligonucleotide"
ucggauuuguucccugguu

SEQ ID NO: 6628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggauuuguucccugguutt

SEQ ID NO: 6629 - RNA, 19 nt, Artificial Sequence
  source: /note="Description of Artificial Sequence: Synthetic oligonucleotide"
caaauccgagagaugaacc

SEQ ID NO: 6630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauccgagagaugaacctt

SEQ ID NO: 6631 - RNA, 19 nt, Artificial Sequence
  source: /note="Description of Artificial Sequence: Synthetic oligonucleotide"
gguucaucucucggauuug

SEQ ID NO: 6632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucaucucucggauuugtt

SEQ ID NO: 6633 - RNA, 19 nt, Artificial Sequence
  source: /note="Description of Artificial Sequence: Synthetic oligonucleotide"
aauccgagagaugaacccu

SEQ ID NO: 6634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauccgagagaugaacccutt

SEQ ID NO: 6635 - RNA, 19 nt, Artificial Sequence
  source: /note="Description of Artificial Sequence: Synthetic oligonucleotide"
aggguucaucucucggauu

SEQ ID NO: 6636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggguucaucucucggauutt

SEQ ID NO: 6637 - RNA, 19 nt, Artificial Sequence
  source: /note="Description of Artificial Sequence: Synthetic oligonucleotide"
auccgagagaugaacccua

SEQ ID NO: 6638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccgagagaugaacccuatt

SEQ ID NO: 6639 - RNA, 19 nt, Artificial Sequence
  source: /note="Description of Artificial Sequence: Synthetic oligonucleotide"
uaggguucaucucucggau

SEQ ID NO: 6640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggguucaucucucggautt

SEQ ID NO: 6641 - RNA, 19 nt, Artificial Sequence
  source: /note="Description of Artificial Sequence: Synthetic oligonucleotide"
ccccccuguucaacuucag

SEQ ID NO: 6642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccccuguucaacuucagtt

SEQ ID NO: 6643 - RNA, 19 nt, Artificial Sequence
  source: /note="Description of Artificial Sequence: Synthetic oligonucleotide"
cugaaguugaacagggggg

SEQ ID NO: 6644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaaguugaacaggggggtt

SEQ ID NO: 6645 - RNA, 19 nt, Artificial Sequence
  source: /note="Description of Artificial Sequence: Synthetic oligonucleotide"
gacuaccccuccacgucca

SEQ ID NO: 6646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuaccccuccacguccatt

SEQ ID NO: 6647 - RNA, 19 nt, Artificial Sequence
  source: /note="Description of Artificial Sequence: Synthetic oligonucleotide"
uggacguggagggguaguc

SEQ ID NO: 6648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacguggagggguaguctt

SEQ ID NO: 6649 - RNA, 19 nt, Artificial Sequence
  source: /note="Description of Artificial Sequence: Synthetic oligonucleotide"
acuaccccuccacguccau

SEQ ID NO: 6650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuaccccuccacguccautt

SEQ ID NO: 6651 - RNA, 19 nt, Artificial Sequence
  source: /note="Description of Artificial Sequence: Synthetic oligonucleotide"
auggacguggagggguagu

SEQ ID NO: 6652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggacguggagggguagutt

SEQ ID NO: 6653 - RNA, 19 nt, Artificial Sequence
  source: /note="Description of Artificial Sequence: Synthetic oligonucleotide"
cuaccccuccacguccauc

SEQ ID NO: 6654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccccuccacguccauctt

SEQ ID NO: 6655 - RNA, 19 nt, Artificial Sequence
  source: /note="Description of Artificial Sequence: Synthetic oligonucleotide"
gauggacguggagggguag

SEQ ID NO: 6656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggacguggagggguagtt

SEQ ID NO: 6657 - RNA, 19 nt, Artificial Sequence
  source: /note="Description of Artificial Sequence: Synthetic oligonucleotide"
gcccaaguggcgcugggaa

SEQ ID NO: 6658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaaguggcgcugggaatt

SEQ ID NO: 6659 - RNA, 19 nt, Artificial Sequence
  source: /note="Description of Artificial Sequence: Synthetic oligonucleotide"
uucccagcgccacuugggc

SEQ ID NO: 6660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccagcgccacuugggctt

SEQ ID NO: 6661 - RNA, 19 nt, Artificial Sequence
  source: /note="Description of Artificial Sequence: Synthetic oligonucleotide"
caaguggcgcugggaaggg

SEQ ID NO: 6662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaguggcgcugggaagggtt

SEQ ID NO: 6663 - RNA, 19 nt, Artificial Sequence
  source: /note="Description of Artificial Sequence: Synthetic oligonucleotide"
cccuucccagcgccacuug

SEQ ID NO: 6664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuucccagcgccacuugtt

SEQ ID NO: 6665 - RNA, 19 nt, Artificial Sequence
  source: /note="Description of Artificial Sequence: Synthetic oligonucleotide"
ggcugggccccuagacuag

SEQ ID NO: 6666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugggccccuagacuagtt

SEQ ID NO: 6667 - RNA, 19 nt, Artificial Sequence
  source: /note="Description of Artificial Sequence: Synthetic oligonucleotide"
cuagucuaggggcccagcc

SEQ ID NO: 6668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagucuaggggcccagcctt

SEQ ID NO: 6669 - RNA, 19 nt, Artificial Sequence
  source: /note="Description of Artificial Sequence: Synthetic oligonucleotide"
ugggccccuagacuagagg

SEQ ID NO: 6670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccccuagacuagaggtt

SEQ ID NO: 6671 - RNA, 19 nt, Artificial Sequence
  source: /note="Description of Artificial Sequence: Synthetic oligonucleotide"
ccucuagucuaggggccca

SEQ ID NO: 6672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuagucuaggggcccatt

SEQ ID NO: 6673 - RNA, 19 nt, Artificial Sequence
  source: /note="Description of Artificial Sequence: Synthetic oligonucleotide"
gccccuagacuagagggca

SEQ ID NO: 6674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccuagacuagagggcatt

SEQ ID NO: 6675 - RNA, 19 nt, Artificial Sequence
  source: /note="Description of Artificial Sequence: Synthetic oligonucleotide"
ugcccucuagucuaggggc

SEQ ID NO: 6676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccucuagucuaggggctt

SEQ ID NO: 6677 - RNA, 19 nt, Artificial Sequence
  source: /note="Description of Artificial Sequence: Synthetic oligonucleotide"
ccuagacuagagggcagag

SEQ ID NO: 6678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuagacuagagggcagagtt

SEQ ID NO: 6679 - RNA, 19 nt, Artificial Sequence
  source: /note="Description of Artificial Sequence: Synthetic oligonucleotide"
cucugcccucuagucuagg

SEQ ID NO: 6680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugcccucuagucuaggtt

SEQ ID NO: 6681 - RNA, 19 nt, Artificial Sequence
  source: /note="Description of Artificial Sequence: Synthetic oligonucleotide"
gacuagagggcagagguaa

SEQ ID NO: 6682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuagagggcagagguaatt

SEQ ID NO: 6683 - RNA, 19 nt, Artificial Sequence
  source: /note="Description of Artificial Sequence: Synthetic oligonucleotide"
uuaccucugcccucuaguc

SEQ ID NO: 6684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaccucugcccucuaguctt

SEQ ID NO: 6685 - RNA, 19 nt, Artificial Sequence
  source: /note="Description of Artificial Sequence: Synthetic oligonucleotide"
gagguaaaugaacuacccc

SEQ ID NO: 6686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagguaaaugaacuacccctt

SEQ ID NO: 6687 - RNA, 19 nt, Artificial Sequence
  source: /note="Description of Artificial Sequence: Synthetic oligonucleotide"
gggguaguucauuuaccuc

SEQ ID NO: 6688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguaguucauuuaccuctt

SEQ ID NO: 6689 - RNA, 19 nt, Artificial Sequence
  source: /note="Description of Artificial Sequence: Synthetic oligonucleotide"
agguaaaugaacuaccccc

SEQ ID NO: 6690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguaaaugaacuaccccctt

SEQ ID NO: 6691 - RNA, 19 nt, Artificial Sequence
  source: /note="Description of Artificial Sequence: Synthetic oligonucleotide"
ggggguaguucauuuaccu

SEQ ID NO: 6692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggguaguucauuuaccutt

SEQ ID NO: 6693 - RNA, 19 nt, Artificial Sequence
  source: /note="Description of Artificial Sequence: Synthetic oligonucleotide"
gguaaaugaacuaccccca

SEQ ID NO: 6694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguaaaugaacuacccccatt

SEQ ID NO: 6695 - RNA, 19 nt, Artificial Sequence
  source: /note="Description of Artificial Sequence: Synthetic oligonucleotide"
uggggguaguucauuuacc

SEQ ID NO: 6696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggguaguucauuuacctt

SEQ ID NO: 6697 - RNA, 19 nt, Artificial Sequence
  source: /note="Description of Artificial Sequence: Synthetic oligonucleotide"
uaaaugaacuacccccagc

SEQ ID NO: 6698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaugaacuacccccagctt

SEQ ID NO: 6699 - RNA, 19 nt, Artificial Sequence
  source: /note="Description of Artificial Sequence: Synthetic oligonucleotide"
gcuggggguaguucauuua

SEQ ID NO: 6700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggggguaguucauuuatt

SEQ ID NO: 6701 - RNA, 19 nt, Artificial Sequence
  source: /note="Description of Artificial Sequence: Synthetic oligonucleotide"
cccccagcaucuaggccuc

SEQ ID NO: 6702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccagcaucuaggccuctt

SEQ ID NO: 6703 - RNA, 19 nt, Artificial Sequence
  source: /note="Description of Artificial Sequence: Synthetic oligonucleotide"
gaggccuagaugcuggggg

SEQ ID NO: 6704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggccuagaugcugggggtt

SEQ ID NO: 6705 - RNA, 19 nt, Artificial Sequence
  source: /note="Description of Artificial Sequence: Synthetic oligonucleotide"
cagcaucuaggccucccuc

SEQ ID NO: 6706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaucuaggccucccuctt

SEQ ID NO: 6707 - RNA, 19 nt, Artificial Sequence
  source: /note="Description of Artificial Sequence: Synthetic oligonucleotide"
gagggaggccuagaugcug

SEQ ID NO: 6708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaggccuagaugcugtt

SEQ ID NO: 6709 - RNA, 19 nt, Artificial Sequence
  source: /note="Description of Artificial Sequence: Synthetic oligonucleotide"
aggacgggguuugggggug

SEQ ID NO: 6710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacgggguuugggggugtt

SEQ ID NO: 6711 - RNA, 19 nt, Artificial Sequence
  source: /note="Description of Artificial Sequence: Synthetic oligonucleotide"
cacccccaaaccccguccu

SEQ ID NO: 6712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacccccaaaccccguccutt

SEQ ID NO: 6713 - RNA, 19 nt, Artificial Sequence
  source: /note="Description of Artificial Sequence: Synthetic oligonucleotide"
ccagagcguucccaagaag

SEQ ID NO: 6714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagagcguucccaagaagtt

SEQ ID NO: 6715 - RNA, 19 nt, Artificial Sequence
  source: /note="Description of Artificial Sequence: Synthetic oligonucleotide"
cuucuugggaacgcucugg

SEQ ID NO: 6716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuugggaacgcucuggtt

SEQ ID NO: 6717 - RNA, 19 nt, Artificial Sequence
  source: /note="Description of Artificial Sequence: Synthetic oligonucleotide"
agcguucccaagaaguggc

SEQ ID NO: 6718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcguucccaagaaguggctt

SEQ ID NO: 6719 - RNA, 19 nt, Artificial Sequence
  source: /note="Description of Artificial Sequence: Synthetic oligonucleotide"
gccacuucuugggaacgcu

SEQ ID NO: 6720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacuucuugggaacgcutt

SEQ ID NO: 6721 - RNA, 19 nt, Artificial Sequence
  source: /note="Description of Artificial Sequence: Synthetic oligonucleotide"
gcaauauugugaggcugcg

SEQ ID NO: 6722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaauauugugaggcugcgtt

SEQ ID NO: 6723 - RNA, 19 nt, Artificial Sequence
  source: /note="Description of Artificial Sequence: Synthetic oligonucleotide"
cgcagccucacaauauugc

SEQ ID NO: 6724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcagccucacaauauugctt

SEQ ID NO: 6725 - RNA, 19 nt, Artificial Sequence
  source: /note="Description of Artificial Sequence: Synthetic oligonucleotide"
cucuuccggagcuuggccu

SEQ ID NO: 6726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuuccggagcuuggccutt

SEQ ID NO: 6727 - RNA, 19 nt, Artificial Sequence
  source: /note="Description of Artificial Sequence: Synthetic oligonucleotide"
aggccaagcuccggaagag

SEQ ID NO: 6728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccaagcuccggaagagtt

SEQ ID NO: 6729 - RNA, 19 nt, Artificial Sequence
  source: /note="Description of Artificial Sequence: Synthetic oligonucleotide"
guucccccagaucaaagcu

SEQ ID NO: 6730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucccccagaucaaagcutt

SEQ ID NO: 6731 - RNA, 19 nt, Artificial Sequence
  source: /note="Description of Artificial Sequence: Synthetic oligonucleotide"
agcuuugaucugggggaac

SEQ ID NO: 6732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuugaucugggggaactt

SEQ ID NO: 6733 - RNA, 19 nt, Artificial Sequence
  source: /note="Description of Artificial Sequence: Synthetic oligonucleotide"
gaggccauugcacucugcu

SEQ ID NO: 6734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggccauugcacucugcutt

SEQ ID NO: 6735 - RNA, 19 nt, Artificial Sequence
  source: /note="Description of Artificial Sequence: Synthetic oligonucleotide"
agcagagugcaauggccuc

SEQ ID NO: 6736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagagugcaauggccuctt

SEQ ID NO: 6737 - RNA, 19 nt, Artificial Sequence
  source: /note="Description of Artificial Sequence: Synthetic oligonucleotide"
cucaucccuccucacuuga

SEQ ID NO: 6738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaucccuccucacuugatt

SEQ ID NO: 6739 - RNA, 19 nt, Artificial Sequence
  source: /note="Description of Artificial Sequence: Synthetic oligonucleotide"
ucaagugaggagggaugag

SEQ ID NO: 6740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagugaggagggaugagtt

SEQ ID NO: 6741 - RNA, 19 nt, Artificial Sequence
  source: /note="Description of Artificial Sequence: Synthetic oligonucleotide"
agacuagagggcagaggua

SEQ ID NO: 6742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacuagagggcagagguatt

SEQ ID NO: 6743 - RNA, 19 nt, Artificial Sequence
  source: /note="Description of Artificial Sequence: Synthetic oligonucleotide"
uaccucugcccucuagucu

SEQ ID NO: 6744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccucugcccucuagucutt

SEQ ID NO: 6745 - RNA, 19 nt, Artificial Sequence
  source: /note="Description of Artificial Sequence: Synthetic oligonucleotide"
ccgggcgcggaccagcucg

SEQ ID NO: 6746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgggcgcggaccagcucgtt

SEQ ID NO: 6747 - RNA, 19 nt, Artificial Sequence
  source: /note="Description of Artificial Sequence: Synthetic oligonucleotide"
cgagcugguccgcgcccgg

SEQ ID NO: 6748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagcugguccgcgcccggtt

SEQ ID NO: 6749 - RNA, 19 nt, Artificial Sequence
  source: /note="Description of Artificial Sequence: Synthetic oligonucleotide"
ucaccgugacaucaagccc

SEQ ID NO: 6750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccgugacaucaagccctt

SEQ ID NO: 6751 - RNA, 19 nt, Artificial Sequence
  source: /note="Description of Artificial Sequence: Synthetic oligonucleotide"
gggcuugaugucacgguga

SEQ ID NO: 6752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuugaugucacggugatt

SEQ ID NO: 6753 - RNA, 19 nt, Artificial Sequence
  source: /note="Description of Artificial Sequence: Synthetic oligonucleotide"
ggccgggcgcggaccagcu

SEQ ID NO: 6754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgggcgcggaccagcutt

SEQ ID NO: 6755 - RNA, 19 nt, Artificial Sequence
  source: /note="Description of Artificial Sequence: Synthetic oligonucleotide"
agcugguccgcgcccggcc

SEQ ID NO: 6756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugguccgcgcccggcctt

SEQ ID NO: 6757 - RNA, 19 nt, Artificial Sequence
  source: /note="Description of Artificial Sequence: Synthetic oligonucleotide"
gcccagagcguucccaaga

SEQ ID NO: 6758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagagcguucccaagatt

SEQ ID NO: 6759 - RNA, 19 nt, Artificial Sequence
  source: /note="Description of Artificial Sequence: Synthetic oligonucleotide"
ucuugggaacgcucugggc

SEQ ID NO: 6760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuugggaacgcucugggctt

SEQ ID NO: 6761 - RNA, 19 nt, Artificial Sequence
  source: /note="Description of Artificial Sequence: Synthetic oligonucleotide"
gagcguucccaagaagugg

SEQ ID NO: 6762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcguucccaagaaguggtt

SEQ ID NO: 6763 - RNA, 19 nt, Artificial Sequence
  source: /note="Description of Artificial Sequence: Synthetic oligonucleotide"
ccacuucuugggaacgcuc

SEQ ID NO: 6764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuucuugggaacgcuctt

SEQ ID NO: 6765 - RNA, 19 nt, Artificial Sequence
  source: /note="Description of Artificial Sequence: Synthetic oligonucleotide"
acugacaucaaagugauug

SEQ ID NO: 6766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugacaucaaagugauugtt

SEQ ID NO: 6767 - RNA, 19 nt, Artificial Sequence
  source: /note="Description of Artificial Sequence: Synthetic oligonucleotide"
caaucacuuugaugucagu

SEQ ID NO: 6768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaucacuuugaugucagutt

SEQ ID NO: 6769 - RNA, 19 nt, Artificial Sequence
  source: /note="Description of Artificial Sequence: Synthetic oligonucleotide"
aucaaagugauugguaaug

SEQ ID NO: 6770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaaagugauugguaaugtt

SEQ ID NO: 6771 - RNA, 19 nt, Artificial Sequence
  source: /note="Description of Artificial Sequence: Synthetic oligonucleotide"
cauuaccaaucacuuugau

SEQ ID NO: 6772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuaccaaucacuuugautt

SEQ ID NO: 6773 - RNA, 19 nt, Artificial Sequence
  source: /note="Description of Artificial Sequence: Synthetic oligonucleotide"
aaagugauugguaauggcu

SEQ ID NO: 6774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagugauugguaauggcutt

SEQ ID NO: 6775 - RNA, 19 nt, Artificial Sequence
  source: /note="Description of Artificial Sequence: Synthetic oligonucleotide"
agccauuaccaaucacuuu

SEQ ID NO: 6776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccauuaccaaucacuuutt

SEQ ID NO: 6777 - RNA, 19 nt, Artificial Sequence
  source: /note="Description of Artificial Sequence: Synthetic oligonucleotide"
gguaauggcucauucggag

SEQ ID NO: 6778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguaauggcucauucggagtt

SEQ ID NO: 6779 - RNA, 19 nt, Artificial Sequence
  source: /note="Description of Artificial Sequence: Synthetic oligonucleotide"
cuccgaaugagccauuacc

SEQ ID NO: 6780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgaaugagccauuacctt

SEQ ID NO: 6781 - RNA, 19 nt, Artificial Sequence
  source: /note="Description of Artificial Sequence: Synthetic oligonucleotide"
auggcucauucggaguagu

SEQ ID NO: 6782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcucauucggaguagutt

SEQ ID NO: 6783 - RNA, 19 nt, Artificial Sequence
  source: /note="Description of Artificial Sequence: Synthetic oligonucleotide"
acuacuccgaaugagccau

SEQ ID NO: 6784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuacuccgaaugagccautt

SEQ ID NO: 6785 - RNA, 19 nt, Artificial Sequence
  source: /note="Description of Artificial Sequence: Synthetic oligonucleotide"
guaagcuggaccacugcaa

SEQ ID NO: 6786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaagcuggaccacugcaatt

SEQ ID NO: 6787 - RNA, 19 nt, Artificial Sequence
  source: /note="Description of Artificial Sequence: Synthetic oligonucleotide"
uugcagugguccagcuuac

SEQ ID NO: 6788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcagugguccagcuuactt

SEQ ID NO: 6789 - RNA, 19 nt, Artificial Sequence
  source: /note="Description of Artificial Sequence: Synthetic oligonucleotide"
gaaucuggugcuggaguau

SEQ ID NO: 6790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaucuggugcuggaguautt

SEQ ID NO: 6791 - RNA, 19 nt, Artificial Sequence
  source: /note="Description of Artificial Sequence: Synthetic oligonucleotide"
auacuccagcaccagauuc

SEQ ID NO: 6792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacuccagcaccagauuctt

SEQ ID NO: 6793 - RNA, 19 nt, Artificial Sequence
  source: /note="Description of Artificial Sequence: Synthetic oligonucleotide"
gaguaugugcccgagacgg

SEQ ID NO: 6794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguaugugcccgagacggtt

SEQ ID NO: 6795 - RNA, 19 nt, Artificial Sequence
  source: /note="Description of Artificial Sequence: Synthetic oligonucleotide"
ccgucucgggcacauacuc

SEQ ID NO: 6796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgucucgggcacauacuctt

SEQ ID NO: 6797 - RNA, 19 nt, Artificial Sequence
  source: /note="Description of Artificial Sequence: Synthetic oligonucleotide"
gugcccgagacgguguacc

SEQ ID NO: 6798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcccgagacgguguacctt

SEQ ID NO: 6799 - RNA, 19 nt, Artificial Sequence
  source: /note="Description of Artificial Sequence: Synthetic oligonucleotide"
gguacaccgucucgggcac

SEQ ID NO: 6800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacaccgucucgggcactt

SEQ ID NO: 6801 - RNA, 19 nt, Artificial Sequence
  source: /note="Description of Artificial Sequence: Synthetic oligonucleotide"
gaguggcccgccacuucac

SEQ ID NO: 6802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguggcccgccacuucactt

SEQ ID NO: 6803 - RNA, 19 nt, Artificial Sequence
  source: /note="Description of Artificial Sequence: Synthetic oligonucleotide"
gugaaguggcgggccacuc

SEQ ID NO: 6804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaaguggcgggccacuctt

SEQ ID NO: 6805 - RNA, 19 nt, Artificial Sequence
  source: /note="Description of Artificial Sequence: Synthetic oligonucleotide"
caccaaggccaagcugauc

SEQ ID NO: 6806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaaggccaagcugauctt

SEQ ID NO: 6807 - RNA, 19 nt, Artificial Sequence
  source: /note="Description of Artificial Sequence: Synthetic oligonucleotide"
gaucagcuuggccuuggug

SEQ ID NO: 6808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucagcuuggccuuggugtt

SEQ ID NO: 6809 - RNA, 19 nt, Artificial Sequence
  source: /note="Description of Artificial Sequence: Synthetic oligonucleotide"
aucaagguguacauguacc

SEQ ID NO: 6810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagguguacauguacctt

SEQ ID NO: 6811 - RNA, 19 nt, Artificial Sequence
  source: /note="Description of Artificial Sequence: Synthetic oligonucleotide"
gguacauguacaccuugau

SEQ ID NO: 6812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacauguacaccuugautt

SEQ ID NO: 6813 - RNA, 19 nt, Artificial Sequence
  source: /note="Description of Artificial Sequence: Synthetic oligonucleotide"
ucaagguguacauguacca

SEQ ID NO: 6814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagguguacauguaccatt

SEQ ID NO: 6815 - RNA, 19 nt, Artificial Sequence
  source: /note="Description of Artificial Sequence: Synthetic oligonucleotide"
ugguacauguacaccuuga

SEQ ID NO: 6816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguacauguacaccuugatt

SEQ ID NO: 6817 - RNA, 19 nt, Artificial Sequence
  source: /note="Description of Artificial Sequence: Synthetic oligonucleotide"
auuugcuuguggacccuga

SEQ ID NO: 6818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugcuuguggacccugatt

SEQ ID NO: 6819 - RNA, 19 nt, Artificial Sequence
  source: /note="Description of Artificial Sequence: Synthetic oligonucleotide"
ucaggguccacaagcaaau

SEQ ID NO: 6820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaggguccacaagcaaautt

SEQ ID NO: 6821 - RNA, 19 nt, Artificial Sequence
  source: /note="Description of Artificial Sequence: Synthetic oligonucleotide"
cuuguggacccugacacug

SEQ ID NO: 6822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguggacccugacacugtt

SEQ ID NO: 6823 - RNA, 19 nt, Artificial Sequence
  source: /note="Description of Artificial Sequence: Synthetic oligonucleotide"
cagugucaggguccacaag

SEQ ID NO: 6824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugucaggguccacaagtt

SEQ ID NO: 6825 - RNA, 19 nt, Artificial Sequence
  source: /note="Description of Artificial Sequence: Synthetic oligonucleotide"
ucaagcucugcgauuuugg

SEQ ID NO: 6826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagcucugcgauuuuggtt

SEQ ID NO: 6827 - RNA, 19 nt, Artificial Sequence
  source: /note="Description of Artificial Sequence: Synthetic oligonucleotide"
ccaaaaucgcagagcuuga

SEQ ID NO: 6828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaaaucgcagagcuugatt

SEQ ID NO: 6829 - RNA, 19 nt, Artificial Sequence
  source: /note="Description of Artificial Sequence: Synthetic oligonucleotide"
caagcucugcgauuuuggc

SEQ ID NO: 6830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcucugcgauuuuggctt

SEQ ID NO: 6831 - RNA, 19 nt, Artificial Sequence
  source: /note="Description of Artificial Sequence: Synthetic oligonucleotide"
gccaaaaucgcagagcuug

SEQ ID NO: 6832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaaaaucgcagagcuugtt

SEQ ID NO: 6833 - RNA, 19 nt, Artificial Sequence
  source: /note="Description of Artificial Sequence: Synthetic oligonucleotide"
gcgauuuuggcagugcaaa

SEQ ID NO: 6834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgauuuuggcagugcaaatt

SEQ ID NO: 6835 - RNA, 19 nt, Artificial Sequence
  source: /note="Description of Artificial Sequence: Synthetic oligonucleotide"
uuugcacugccaaaaucgc

SEQ ID NO: 6836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugcacugccaaaaucgctt

SEQ ID NO: 6837 - RNA, 19 nt, Artificial Sequence
  source: /note="Description of Artificial Sequence: Synthetic oligonucleotide"
ggcagugcaaagcagcugg

SEQ ID NO: 6838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagugcaaagcagcuggtt

SEQ ID NO: 6839 - RNA, 19 nt, Artificial Sequence
  source: /note="Description of Artificial Sequence: Synthetic oligonucleotide"
ccagcugcuuugcacugcc

SEQ ID NO: 6840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcugcuuugcacugcctt

SEQ ID NO: 6841 - RNA, 19 nt, Artificial Sequence
  source: /note="Description of Artificial Sequence: Synthetic oligonucleotide"
gguacuaccgugcuccaga

SEQ ID NO: 6842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacuaccgugcuccagatt

SEQ ID NO: 6843 - RNA, 19 nt, Artificial Sequence
  source: /note="Description of Artificial Sequence: Synthetic oligonucleotide"
ucuggagcacgguaguacc

SEQ ID NO: 6844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggagcacgguaguacctt

SEQ ID NO: 6845 - RNA, 19 nt, Artificial Sequence
  source: /note="Description of Artificial Sequence: Synthetic oligonucleotide"
uaccgugcuccagaacuca

SEQ ID NO: 6846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgugcuccagaacucatt

SEQ ID NO: 6847 - RNA, 19 nt, Artificial Sequence
  source: /note="Description of Artificial Sequence: Synthetic oligonucleotide"
ugaguucuggagcacggua

SEQ ID NO: 6848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaguucuggagcacgguatt

SEQ ID NO: 6849 - RNA, 19 nt, Artificial Sequence
  source: /note="Description of Artificial Sequence: Synthetic oligonucleotide"
aucaucaagguacuaggaa

SEQ ID NO: 6850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaucaagguacuaggaatt

SEQ ID NO: 6851 - RNA, 19 nt, Artificial Sequence
  source: /note="Description of Artificial Sequence: Synthetic oligonucleotide"
uuccuaguaccuugaugau

SEQ ID NO: 6852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuaguaccuugaugautt

SEQ ID NO: 6853 - RNA, 19 nt, Artificial Sequence
  source: /note="Description of Artificial Sequence: Synthetic oligonucleotide"
aucaagguacuaggaacgc

SEQ ID NO: 6854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagguacuaggaacgctt

SEQ ID NO: 6855 - RNA, 19 nt, Artificial Sequence
  source: /note="Description of Artificial Sequence: Synthetic oligonucleotide"
gcguuccuaguaccuugau

SEQ ID NO: 6856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcguuccuaguaccuugautt

SEQ ID NO: 6857 - RNA, 19 nt, Artificial Sequence
  source: /note="Description of Artificial Sequence: Synthetic oligonucleotide"
acuaggaacgccaaccagg

SEQ ID NO: 6858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuaggaacgccaaccaggtt

SEQ ID NO: 6859 - RNA, 19 nt, Artificial Sequence
  source: /note="Description of Artificial Sequence: Synthetic oligonucleotide"
ccugguuggcguuccuagu

SEQ ID NO: 6860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugguuggcguuccuagutt

SEQ ID NO: 6861 - RNA, 19 nt, Artificial Sequence
  source: /note="Description of Artificial Sequence: Synthetic oligonucleotide"
cgccaaccagggaacaaau

SEQ ID NO: 6862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccaaccagggaacaaautt

SEQ ID NO: 6863 - RNA, 19 nt, Artificial Sequence
  source: /note="Description of Artificial Sequence: Synthetic oligonucleotide"
auuuguucccugguuggcg

SEQ ID NO: 6864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuguucccugguuggcgtt

SEQ ID NO: 6865 - RNA, 19 nt, Artificial Sequence
  source: /note="Description of Artificial Sequence: Synthetic oligonucleotide"
gggaacaaauccgagagau

SEQ ID NO: 6866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaacaaauccgagagautt

SEQ ID NO: 6867 - RNA, 19 nt, Artificial Sequence
  source: /note="Description of Artificial Sequence: Synthetic oligonucleotide"
aucucucggauuuguuccc

SEQ ID NO: 6868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucucucggauuuguuccctt

SEQ ID NO: 6869 - RNA, 19 nt, Artificial Sequence
  source: /note="Description of Artificial Sequence: Synthetic oligonucleotide"
gaacaaauccgagagauga

SEQ ID NO: 6870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacaaauccgagagaugatt

SEQ ID NO: 6871 - RNA, 19 nt, Artificial Sequence
  source: /note="Description of Artificial Sequence: Synthetic oligonucleotide"
ucaucucucggauuuguuc

SEQ ID NO: 6872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucucucggauuuguuctt

SEQ ID NO: 6873 - RNA, 19 nt, Artificial Sequence
  source: /note="Description of Artificial Sequence: Synthetic oligonucleotide"
aacaaauccgagagaugaa

SEQ ID NO: 6874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaaauccgagagaugaatt

SEQ ID NO: 6875 - RNA, 19 nt, Artificial Sequence
  source: /note="Description of Artificial Sequence: Synthetic oligonucleotide"
uucaucucucggauuuguu

SEQ ID NO: 6876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaucucucggauuuguutt

SEQ ID NO: 6877 - RNA, 19 nt, Artificial Sequence
  source: /note="Description of Artificial Sequence: Synthetic oligonucleotide"
acaaauccgagagaugaac

SEQ ID NO: 6878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaauccgagagaugaactt

SEQ ID NO: 6879 - RNA, 19 nt, Artificial Sequence
  source: /note="Description of Artificial Sequence: Synthetic oligonucleotide"
guucaucucucggauuugu

SEQ ID NO: 6880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaucucucggauuugutt

SEQ ID NO: 6881 - RNA, 19 nt, Artificial Sequence
  source: /note="Description of Artificial Sequence: Synthetic oligonucleotide"
agcuccccaacgaccgccc

SEQ ID NO: 6882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuccccaacgaccgccctt

SEQ ID NO: 6883 - RNA, 19 nt, Artificial Sequence
  source: /note="Description of Artificial Sequence: Synthetic oligonucleotide"
gggcggucguuggggagcu

SEQ ID NO: 6884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcggucguuggggagcutt

SEQ ID NO: 6885 - RNA, 19 nt, Artificial Sequence
  source: /note="Description of Artificial Sequence: Synthetic oligonucleotide"
gcuccccaacgaccgcccg

SEQ ID NO: 6886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccccaacgaccgcccgtt

SEQ ID NO: 6887 - RNA, 19 nt, Artificial Sequence
  source: /note="Description of Artificial Sequence: Synthetic oligonucleotide"
cgggcggucguuggggagc

SEQ ID NO: 6888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcggucguuggggagctt

SEQ ID NO: 6889 - RNA, 19 nt, Artificial Sequence
  source: /note="Description of Artificial Sequence: Synthetic oligonucleotide"
cucacaagcuuuaacugaa

SEQ ID NO: 6890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucacaagcuuuaacugaatt

SEQ ID NO: 6891 - RNA, 19 nt, Artificial Sequence
  source: /note="Description of Artificial Sequence: Synthetic oligonucleotide"
uucaguuaaagcuugugag

SEQ ID NO: 6892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaguuaaagcuugugagtt

SEQ ID NO: 6893 - RNA, 19 nt, Artificial Sequence
  source: /note="Description of Artificial Sequence: Synthetic oligonucleotide"
gccccaccgacuaccccuc

SEQ ID NO: 6894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccaccgacuaccccuctt

SEQ ID NO: 6895 - RNA, 19 nt, Artificial Sequence
  source: /note="Description of Artificial Sequence: Synthetic oligonucleotide"
gagggguagucgguggggc

SEQ ID NO: 6896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggguagucgguggggctt

SEQ ID NO: 6897 - RNA, 19 nt, Artificial Sequence
  source: /note="Description of Artificial Sequence: Synthetic oligonucleotide"
cccaccgacuaccccucca

SEQ ID NO: 6898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaccgacuaccccuccatt

SEQ ID NO: 6899 - RNA, 19 nt, Artificial Sequence
  source: /note="Description of Artificial Sequence: Synthetic oligonucleotide"
uggagggguagucgguggg

SEQ ID NO: 6900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagggguagucggugggtt

SEQ ID NO: 6901 - RNA, 19 nt, Artificial Sequence
  source: /note="Description of Artificial Sequence: Synthetic oligonucleotide"
ccuccacguccaucuggga

SEQ ID NO: 6902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccacguccaucugggatt

SEQ ID NO: 6903 - RNA, 19 nt, Artificial Sequence
  source: /note="Description of Artificial Sequence: Synthetic oligonucleotide"
ucccagauggacguggagg

SEQ ID NO: 6904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccagauggacguggaggtt

SEQ ID NO: 6905 - RNA, 19 nt, Artificial Sequence
  source: /note="Description of Artificial Sequence: Synthetic oligonucleotide"
ccacguccaucugggaagg

SEQ ID NO: 6906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacguccaucugggaaggtt

SEQ ID NO: 6907 - RNA, 19 nt, Artificial Sequence
  source: /note="Description of Artificial Sequence: Synthetic oligonucleotide"
ccuucccagauggacgugg

SEQ ID NO: 6908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucccagauggacguggtt

SEQ ID NO: 6909 - RNA, 19 nt, Artificial Sequence
  source: /note="Description of Artificial Sequence: Synthetic oligonucleotide"
cccaaguggcgcugggaag

SEQ ID NO: 6910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaaguggcgcugggaagtt

SEQ ID NO: 6911 - RNA, 19 nt, Artificial Sequence
  source: /note="Description of Artificial Sequence: Synthetic oligonucleotide"
cuucccagcgccacuuggg

SEQ ID NO: 6912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccagcgccacuugggtt

SEQ ID NO: 6913 - RNA, 19 nt, Artificial Sequence
  source: /note="Description of Artificial Sequence: Synthetic oligonucleotide"
ccaaguggcgcugggaagg

SEQ ID NO: 6914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaguggcgcugggaaggtt

SEQ ID NO: 6915 - RNA, 19 nt, Artificial Sequence
  source: /note="Description of Artificial Sequence: Synthetic oligonucleotide"
ccuucccagcgccacuugg

SEQ ID NO: 6916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucccagcgccacuuggtt

SEQ ID NO: 6917 - RNA, 19 nt, Artificial Sequence
  source: /note="Description of Artificial Sequence: Synthetic oligonucleotide"
cagcccaucaagcuccugc

SEQ ID NO: 6918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcccaucaagcuccugctt

SEQ ID NO: 6919 - RNA, 19 nt, Artificial Sequence
  source: /note="Description of Artificial Sequence: Synthetic oligonucleotide"
gcaggagcuugaugggcug

SEQ ID NO: 6920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaggagcuugaugggcugtt

SEQ ID NO: 6921 - RNA, 19 nt, Artificial Sequence
  source: /note="Description of Artificial Sequence: Synthetic oligonucleotide"
gcugggccccuagacuaga

SEQ ID NO: 6922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggccccuagacuagatt

SEQ ID NO: 6923 - RNA, 19 nt, Artificial Sequence
  source: /note="Description of Artificial Sequence: Synthetic oligonucleotide"
ucuagucuaggggcccagc

SEQ ID NO: 6924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuagucuaggggcccagctt

SEQ ID NO: 6925 - RNA, 19 nt, Artificial Sequence
  source: /note="Description of Artificial Sequence: Synthetic oligonucleotide"
ccccuagacuagagggcag

SEQ ID NO: 6926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuagacuagagggcagtt

SEQ ID NO: 6927 - RNA, 19 nt, Artificial Sequence
  source: /note="Description of Artificial Sequence: Synthetic oligonucleotide"
cugcccucuagucuagggg

SEQ ID NO: 6928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcccucuagucuaggggtt

SEQ ID NO: 6929 - RNA, 19 nt, Artificial Sequence
  source: /note="Description of Artificial Sequence: Synthetic oligonucleotide"
cccuagacuagagggcaga

SEQ ID NO: 6930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuagacuagagggcagatt

SEQ ID NO: 6931 - RNA, 19 nt, Artificial Sequence
  source: /note="Description of Artificial Sequence: Synthetic oligonucleotide"
ucugcccucuagucuaggg

SEQ ID NO: 6932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcccucuagucuagggtt

SEQ ID NO: 6933 - RNA, 19 nt, Artificial Sequence
  source: /note="Description of Artificial Sequence: Synthetic oligonucleotide"
uagacuagagggcagaggu

SEQ ID NO: 6934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagacuagagggcagaggutt

SEQ ID NO: 6935 - RNA, 19 nt, Artificial Sequence
  source: /note="Description of Artificial Sequence: Synthetic oligonucleotide"
accucugcccucuagucua

SEQ ID NO: 6936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucugcccucuagucuatt

SEQ ID NO: 6937 - RNA, 19 nt, Artificial Sequence
  source: /note="Description of Artificial Sequence: Synthetic oligonucleotide"
ggcagagguaaaugaacua

SEQ ID NO: 6938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagagguaaaugaacuatt

SEQ ID NO: 6939 - RNA, 19 nt, Artificial Sequence
  source: /note="Description of Artificial Sequence: Synthetic oligonucleotide"
uaguucauuuaccucugcc

SEQ ID NO: 6940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguucauuuaccucugcctt

SEQ ID NO: 6941 - RNA, 19 nt, Artificial Sequence
  source: /note="Description of Artificial Sequence: Synthetic oligonucleotide"
gcagagguaaaugaacuac

SEQ ID NO: 6942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagguaaaugaacuactt

SEQ ID NO: 6943 - RNA, 19 nt, Artificial Sequence
  source: /note="Description of Artificial Sequence: Synthetic oligonucleotide"
guaguucauuuaccucugc

SEQ ID NO: 6944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaguucauuuaccucugctt

SEQ ID NO: 6945 - RNA, 19 nt, Artificial Sequence
  source: /note="Description of Artificial Sequence: Synthetic oligonucleotide"
aaaugaacuacccccagca

SEQ ID NO: 6946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaugaacuacccccagcatt

SEQ ID NO: 6947 - RNA, 19 nt, Artificial Sequence
  source: /note="Description of Artificial Sequence: Synthetic oligonucleotide"
ugcuggggguaguucauuu

SEQ ID NO: 6948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuggggguaguucauuutt

SEQ ID NO: 6949 - RNA, 19 nt, Artificial Sequence
  source: /note="Description of Artificial Sequence: Synthetic oligonucleotide"
augaacuacccccagcauc

SEQ ID NO: 6950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaacuacccccagcauctt

SEQ ID NO: 6951 - RNA, 19 nt, Artificial Sequence
  source: /note="Description of Artificial Sequence: Synthetic oligonucleotide"
gaugcuggggguaguucau

SEQ ID NO: 6952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugcuggggguaguucautt

SEQ ID NO: 6953 - RNA, 19 nt, Artificial Sequence
  source: /note="Description of Artificial Sequence: Synthetic oligonucleotide"
ugaacuacccccagcaucu

SEQ ID NO: 6954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacuacccccagcaucutt

SEQ ID NO: 6955 - RNA, 19 nt, Artificial Sequence
  source: /note="Description of Artificial Sequence: Synthetic oligonucleotide"
agaugcuggggguaguuca

SEQ ID NO: 6956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugcuggggguaguucatt

SEQ ID NO: 6957 - RNA, 19 nt, Artificial Sequence
  source: /note="Description of Artificial Sequence: Synthetic oligonucleotide"
uacccccagcaucuaggcc

SEQ ID NO: 6958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacccccagcaucuaggcctt

SEQ ID NO: 6959 - RNA, 19 nt, Artificial Sequence
  source: /note="Description of Artificial Sequence: Synthetic oligonucleotide"
ggccuagaugcugggggua

SEQ ID NO: 6960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuagaugcuggggguatt

SEQ ID NO: 6961 - RNA, 19 nt, Artificial Sequence
  source: /note="Description of Artificial Sequence: Synthetic oligonucleotide"
cccagcaucuaggccuccc

SEQ ID NO: 6962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcaucuaggccuccctt

SEQ ID NO: 6963 - RNA, 19 nt, Artificial Sequence
  source: /note="Description of Artificial Sequence: Synthetic oligonucleotide"
gggaggccuagaugcuggg

SEQ ID NO: 6964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggccuagaugcugggtt

SEQ ID NO: 6965 - RNA, 19 nt, Artificial Sequence
  source: /note="Description of Artificial Sequence: Synthetic oligonucleotide"
ccagcaucuaggccucccu

SEQ ID NO: 6966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcaucuaggccucccutt

SEQ ID NO: 6967 - RNA, 19 nt, Artificial Sequence
  source: /note="Description of Artificial Sequence: Synthetic oligonucleotide"
agggaggccuagaugcugg

SEQ ID NO: 6968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaggccuagaugcuggtt

SEQ ID NO: 6969 - RNA, 19 nt, Artificial Sequence
  source: /note="Description of Artificial Sequence: Synthetic oligonucleotide"
ggaaggacgggguuugggg

SEQ ID NO: 6970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaggacgggguuuggggtt

SEQ ID NO: 6971 - RNA, 19 nt, Artificial Sequence
  source: /note="Description of Artificial Sequence: Synthetic oligonucleotide"
ccccaaaccccguccuucc

SEQ ID NO: 6972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccaaaccccguccuucctt

SEQ ID NO: 6973 - RNA, 19 nt, Artificial Sequence
  source: /note="Description of Artificial Sequence: Synthetic oligonucleotide"
gaaggacgggguuuggggg

SEQ ID NO: 6974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggacgggguuugggggtt

SEQ ID NO: 6975 - RNA, 19 nt, Artificial Sequence
  source: /note="Description of Artificial Sequence: Synthetic oligonucleotide"
cccccaaaccccguccuuc

SEQ ID NO: 6976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccaaaccccguccuuctt

SEQ ID NO: 6977 - RNA, 19 nt, Artificial Sequence
  source: /note="Description of Artificial Sequence: Synthetic oligonucleotide"
ucuacccccuugguccccu

SEQ ID NO: 6978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacccccuugguccccutt

SEQ ID NO: 6979 - RNA, 19 nt, Artificial Sequence
  source: /note="Description of Artificial Sequence: Synthetic oligonucleotide"
aggggaccaaggggguaga

SEQ ID NO: 6980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggaccaaggggguagatt

SEQ ID NO: 6981 - RNA, 19 nt, Artificial Sequence
  source: /note="Description of Artificial Sequence: Synthetic oligonucleotide"
cggagccggagcccgaacg

SEQ ID NO: 6982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagccggagcccgaacgtt

SEQ ID NO: 6983 - RNA, 19 nt, Artificial Sequence
  source: /note="Description of Artificial Sequence: Synthetic oligonucleotide"
cguucgggcuccggcuccg

SEQ ID NO: 6984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguucgggcuccggcuccgtt

SEQ ID NO: 6985 - RNA, 19 nt, Artificial Sequence
  source: /note="Description of Artificial Sequence: Synthetic oligonucleotide"
gaggcggcggcagaggcag

SEQ ID NO: 6986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcggcggcagaggcagtt

SEQ ID NO: 6987 - RNA, 19 nt, Artificial Sequence
  source: /note="Description of Artificial Sequence: Synthetic oligonucleotide"
cugccucugccgccgccuc

SEQ ID NO: 6988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccucugccgccgccuctt

SEQ ID NO: 6989 - RNA, 19 nt, Artificial Sequence
  source: /note="Description of Artificial Sequence: Synthetic oligonucleotide"
cgccaugagcggcggcggg

SEQ ID NO: 6990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccaugagcggcggcgggtt

SEQ ID NO: 6991 - RNA, 19 nt, Artificial Sequence
  source: /note="Description of Artificial Sequence: Synthetic oligonucleotide"
cccgccgccgcucauggcg

SEQ ID NO: 6992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccgccgcucauggcgtt

SEQ ID NO: 6993 - RNA, 19 nt, Artificial Sequence
  source: /note="Description of Artificial Sequence: Synthetic oligonucleotide"
ggcccugggggcucgggcc

SEQ ID NO: 6994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccugggggcucgggcctt

SEQ ID NO: 6995 - RNA, 19 nt, Artificial Sequence
  source: /note="Description of Artificial Sequence: Synthetic oligonucleotide"
ggcccgagcccccagggcc

SEQ ID NO: 6996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccgagcccccagggcctt

SEQ ID NO: 6997 - RNA, 19 nt, Artificial Sequence
  source: /note="Description of Artificial Sequence: Synthetic oligonucleotide"
gcccugggggcucgggccg

SEQ ID NO: 6998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccugggggcucgggccgtt

SEQ ID NO: 6999 - RNA, 19 nt, Artificial Sequence
  source: /note="Description of Artificial Sequence: Synthetic oligonucleotide"
cggcccgagcccccagggc

SEQ ID NO: 7000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcccgagcccccagggctt

SEQ ID NO: 7001 - RNA, 19 nt, Artificial Sequence
  source: /note="Description of Artificial Sequence: Synthetic oligonucleotide"
gggccgggcgcggaccagc

SEQ ID NO: 7002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccgggcgcggaccagctt

SEQ ID NO: 7003 - RNA, 19 nt, Artificial Sequence
  source: /note="Description of Artificial Sequence: Synthetic oligonucleotide"
gcugguccgcgcccggccc

SEQ ID NO: 7004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguccgcgcccggccctt

SEQ ID NO: 7005 - RNA, 19 nt, Artificial Sequence
  source: /note="Description of Artificial Sequence: Synthetic oligonucleotide"
cgggcgcggaccagcucgu

SEQ ID NO: 7006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcgcggaccagcucgutt

SEQ ID NO: 7007 - RNA, 19 nt, Artificial Sequence
  source: /note="Description of Artificial Sequence: Synthetic oligonucleotide"
acgagcugguccgcgcccg

SEQ ID NO: 7008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgagcugguccgcgcccgtt

SEQ ID NO: 7009 - RNA, 19 nt, Artificial Sequence
  source: /note="Description of Artificial Sequence: Synthetic oligonucleotide"
ggccucuggcccaggaggc

SEQ ID NO: 7010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccucuggcccaggaggctt

SEQ ID NO: 7011 - RNA, 19 nt, Artificial Sequence
  source: /note="Description of Artificial Sequence: Synthetic oligonucleotide"
gccuccugggccagaggcc

SEQ ID NO: 7012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuccugggccagaggcctt

SEQ ID NO: 7013 - RNA, 19 nt, Artificial Sequence
  source: /note="Description of Artificial Sequence: Synthetic oligonucleotide"
cucuggcccaggaggcacu

SEQ ID NO: 7014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuggcccaggaggcacutt

SEQ ID NO: 7015 - RNA, 19 nt, Artificial Sequence
  source: /note="Description of Artificial Sequence: Synthetic oligonucleotide"
agugccuccugggccagag

SEQ ID NO: 7016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugccuccugggccagagtt

SEQ ID NO: 7017 - RNA, 19 nt, Artificial Sequence
  source: /note="Description of Artificial Sequence: Synthetic oligonucleotide"
ggggcuaugggugggggcg

SEQ ID NO: 7018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcuaugggugggggcgtt

SEQ ID NO: 7019 - RNA, 19 nt, Artificial Sequence
  source: /note="Description of Artificial Sequence: Synthetic oligonucleotide"
cgcccccacccauagcccc

SEQ ID NO: 7020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcccccacccauagcccctt

SEQ ID NO: 7021 - RNA, 19 nt, Artificial Sequence
  source: /note="Description of Artificial Sequence: Synthetic oligonucleotide"
ggcuaugggugggggcgug

SEQ ID NO: 7022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuaugggugggggcgugtt

SEQ ID NO: 7023 - RNA, 19 nt, Artificial Sequence
  source: /note="Description of Artificial Sequence: Synthetic oligonucleotide"
cacgcccccacccauagcc

SEQ ID NO: 7024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacgcccccacccauagcctt

SEQ ID NO: 7025 - RNA, 19 nt, Artificial Sequence
  source: /note="Description of Artificial Sequence: Synthetic oligonucleotide"
cuaugggugggggcguggg

SEQ ID NO: 7026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaugggugggggcgugggtt

SEQ ID NO: 7027 - RNA, 19 nt, Artificial Sequence
  source: /note="Description of Artificial Sequence: Synthetic oligonucleotide"
cccacgcccccacccauag

SEQ ID NO: 7028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacgcccccacccauagtt

SEQ ID NO: 7029 - RNA, 19 nt, Artificial Sequence
  source: /note="Description of Artificial Sequence: Synthetic oligonucleotide"
augggugggggcgugggag

SEQ ID NO: 7030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augggugggggcgugggagtt

SEQ ID NO: 7031 - RNA, 19 nt, Artificial Sequence
  source: /note="Description of Artificial Sequence: Synthetic oligonucleotide"
cucccacgcccccacccau

SEQ ID NO: 7032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccacgcccccacccautt

SEQ ID NO: 7033 - RNA, 19 nt, Artificial Sequence
  source: /note="Description of Artificial Sequence: Synthetic oligonucleotide"
gugggggcgugggagccuc

SEQ ID NO: 7034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugggggcgugggagccuctt

SEQ ID NO: 7035 - RNA, 19 nt, Artificial Sequence
  source: /note="Description of Artificial Sequence: Synthetic oligonucleotide"
gaggcucccacgcccccac

SEQ ID NO: 7036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcucccacgcccccactt

SEQ ID NO: 7037 - RNA, 19 nt, Artificial Sequence
  source: /note="Description of Artificial Sequence: Synthetic oligonucleotide"
gggggcgugggagccucga

SEQ ID NO: 7038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggcgugggagccucgatt

SEQ ID NO: 7039 - RNA, 19 nt, Artificial Sequence
  source: /note="Description of Artificial Sequence: Synthetic oligonucleotide"
ucgaggcucccacgccccc

SEQ ID NO: 7040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaggcucccacgccccctt

SEQ ID NO: 7041 - RNA, 19 nt, Artificial Sequence
  source: /note="Description of Artificial Sequence: Synthetic oligonucleotide"
ggggcgugggagccucgag

SEQ ID NO: 7042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcgugggagccucgagtt

SEQ ID NO: 7043 - RNA, 19 nt, Artificial Sequence
  source: /note="Description of Artificial Sequence: Synthetic oligonucleotide"
cucgaggcucccacgcccc

SEQ ID NO: 7044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgaggcucccacgcccctt

SEQ ID NO: 7045 - RNA, 19 nt, Artificial Sequence
  source: /note="Description of Artificial Sequence: Synthetic oligonucleotide"
gggcgugggagccucgagc

SEQ ID NO: 7046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcgugggagccucgagctt

SEQ ID NO: 7047 - RNA, 19 nt, Artificial Sequence
  source: /note="Description of Artificial Sequence: Synthetic oligonucleotide"
gcucgaggcucccacgccc

SEQ ID NO: 7048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucgaggcucccacgccctt

SEQ ID NO: 7049 - RNA, 19 nt, Artificial Sequence
  source: /note="Description of Artificial Sequence: Synthetic oligonucleotide"
ggcgugggagccucgagcu

SEQ ID NO: 7050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgugggagccucgagcutt

SEQ ID NO: 7051 - RNA, 19 nt, Artificial Sequence
  source: /note="Description of Artificial Sequence: Synthetic oligonucleotide"
agcucgaggcucccacgcc

SEQ ID NO: 7052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucgaggcucccacgcctt

SEQ ID NO: 7053 - RNA, 19 nt, Artificial Sequence
  source: /note="Description of Artificial Sequence: Synthetic oligonucleotide"
cgugggagccucgagcucc

SEQ ID NO: 7054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugggagccucgagcucctt

SEQ ID NO: 7055 - RNA, 19 nt, Artificial Sequence
  source: /note="Description of Artificial Sequence: Synthetic oligonucleotide"
ggagcucgaggcucccacg

SEQ ID NO: 7056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcucgaggcucccacgtt

SEQ ID NO: 7057 - RNA, 19 nt, Artificial Sequence
  source: /note="Description of Artificial Sequence: Synthetic oligonucleotide"
gaaggugaccacaguggua

SEQ ID NO: 7058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggugaccacagugguatt

SEQ ID NO: 7059 - RNA, 19 nt, Artificial Sequence
  source: /note="Description of Artificial Sequence: Synthetic oligonucleotide"
uaccacuguggucaccuuc

SEQ ID NO: 7060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccacuguggucaccuuctt

SEQ ID NO: 7061 - RNA, 19 nt, Artificial Sequence
  source: /note="Description of Artificial Sequence: Synthetic oligonucleotide"
aggugaccacagugguagc

SEQ ID NO: 7062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggugaccacagugguagctt

SEQ ID NO: 7063 - RNA, 19 nt, Artificial Sequence
  source: /note="Description of Artificial Sequence: Synthetic oligonucleotide"
gcuaccacuguggucaccu

SEQ ID NO: 7064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaccacuguggucaccutt

SEQ ID NO: 7065 - RNA, 19 nt, Artificial Sequence
  source: /note="Description of Artificial Sequence: Synthetic oligonucleotide"
ggugaccacagugguagcc

SEQ ID NO: 7066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugaccacagugguagcctt

SEQ ID NO: 7067 - RNA, 19 nt, Artificial Sequence
  source: /note="Description of Artificial Sequence: Synthetic oligonucleotide"
ggcuaccacuguggucacc

SEQ ID NO: 7068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuaccacuguggucacctt

SEQ ID NO: 7069 - RNA, 19 nt, Artificial Sequence
  source: /note="Description of Artificial Sequence: Synthetic oligonucleotide"
acacugacaucaaagugau

SEQ ID NO: 7070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacugacaucaaagugautt

SEQ ID NO: 7071 - RNA, 19 nt, Artificial Sequence
  source: /note="Description of Artificial Sequence: Synthetic oligonucleotide"
aucacuuugaugucagugu

SEQ ID NO: 7072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucacuuugaugucagugutt

SEQ ID NO: 7073 - RNA, 19 nt, Artificial Sequence
  source: /note="Description of Artificial Sequence: Synthetic oligonucleotide"
cacugacaucaaagugauu

SEQ ID NO: 7074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugacaucaaagugauutt

SEQ ID NO: 7075 - RNA, 19 nt, Artificial Sequence
  source: /note="Description of Artificial Sequence: Synthetic oligonucleotide"
aaucacuuugaugucagug

SEQ ID NO: 7076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucacuuugaugucagugtt

SEQ ID NO: 7077 - RNA, 19 nt, Artificial Sequence
  source: /note="Description of Artificial Sequence: Synthetic oligonucleotide"
ugacaucaaagugauuggu

SEQ ID NO: 7078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacaucaaagugauuggutt

SEQ ID NO: 7079 - RNA, 19 nt, Artificial Sequence
  source: /note="Description of Artificial Sequence: Synthetic oligonucleotide"
accaaucacuuugauguca

SEQ ID NO: 7080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaaucacuuugaugucatt

SEQ ID NO: 7081 - RNA, 19 nt, Artificial Sequence
  source: /note="Description of Artificial Sequence: Synthetic oligonucleotide"
gacaucaaagugauuggua

SEQ ID NO: 7082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaucaaagugauugguatt

SEQ ID NO: 7083 - RNA, 19 nt, Artificial Sequence
  source: /note="Description of Artificial Sequence: Synthetic oligonucleotide"
uaccaaucacuuugauguc

SEQ ID NO: 7084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccaaucacuuugauguctt

SEQ ID NO: 7085 - RNA, 19 nt, Artificial Sequence
  source: /note="Description of Artificial Sequence: Synthetic oligonucleotide"
acaucaaagugauugguaa

SEQ ID NO: 7086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucaaagugauugguaatt

SEQ ID NO: 7087 - RNA, 19 nt, Artificial Sequence
  source: /note="Description of Artificial Sequence: Synthetic oligonucleotide"
uuaccaaucacuuugaugu

SEQ ID NO: 7088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaccaaucacuuugaugutt

SEQ ID NO: 7089 - RNA, 19 nt, Artificial Sequence
  source: /note="Description of Artificial Sequence: Synthetic oligonucleotide"
caucaaagugauugguaau

SEQ ID NO: 7090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaaagugauugguaautt

SEQ ID NO: 7091 - RNA, 19 nt, Artificial Sequence
  source: /note="Description of Artificial Sequence: Synthetic oligonucleotide"
auuaccaaucacuuugaug

SEQ ID NO: 7092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuaccaaucacuuugaugtt

SEQ ID NO: 7093 - RNA, 19 nt, Artificial Sequence
  source: /note="Description of Artificial Sequence: Synthetic oligonucleotide"
ucaaagugauugguaaugg

SEQ ID NO: 7094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaagugauugguaauggtt

SEQ ID NO: 7095 - RNA, 19 nt, Artificial Sequence
  source: /note="Description of Artificial Sequence: Synthetic oligonucleotide"
ccauuaccaaucacuuuga

SEQ ID NO: 7096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauuaccaaucacuuugatt

SEQ ID NO: 7097 - RNA, 19 nt, Artificial Sequence
  source: /note="Description of Artificial Sequence: Synthetic oligonucleotide"
caaagugauugguaauggc

SEQ ID NO: 7098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagugauugguaauggctt

SEQ ID NO: 7099 - RNA, 19 nt, Artificial Sequence
  source: /note="Description of Artificial Sequence: Synthetic oligonucleotide"
gccauuaccaaucacuuug

SEQ ID NO: 7100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccauuaccaaucacuuugtt

SEQ ID NO: 7101 - RNA, 19 nt, Artificial Sequence
  source: /note="Description of Artificial Sequence: Synthetic oligonucleotide"
ugauugguaauggcucauu

SEQ ID NO: 7102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauugguaauggcucauutt

SEQ ID NO: 7103 - RNA, 19 nt, Artificial Sequence
  source: /note="Description of Artificial Sequence: Synthetic oligonucleotide"
aaugagccauuaccaauca

SEQ ID NO: 7104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugagccauuaccaaucatt

SEQ ID NO: 7105 - RNA, 19 nt, Artificial Sequence
  source: /note="Description of Artificial Sequence: Synthetic oligonucleotide"
gauugguaauggcucauuc

SEQ ID NO: 7106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauugguaauggcucauuctt

SEQ ID NO: 7107 - RNA, 19 nt, Artificial Sequence
  source: /note="Description of Artificial Sequence: Synthetic oligonucleotide"
gaaugagccauuaccaauc

SEQ ID NO: 7108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaugagccauuaccaauctt

SEQ ID NO: 7109 - RNA, 19 nt, Artificial Sequence
  source: /note="Description of Artificial Sequence: Synthetic oligonucleotide"
auugguaauggcucauucg

SEQ ID NO: 7110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugguaauggcucauucgtt

SEQ ID NO: 7111 - RNA, 19 nt, Artificial Sequence
  source: /note="Description of Artificial Sequence: Synthetic oligonucleotide"
cgaaugagccauuaccaau

SEQ ID NO: 7112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaaugagccauuaccaautt

SEQ ID NO: 7113 - RNA, 19 nt, Artificial Sequence
  source: /note="Description of Artificial Sequence: Synthetic oligonucleotide"
uugguaauggcucauucgg

SEQ ID NO: 7114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguaauggcucauucggtt

SEQ ID NO: 7115 - RNA, 19 nt, Artificial Sequence
  source: /note="Description of Artificial Sequence: Synthetic oligonucleotide"
ccgaaugagccauuaccaa

SEQ ID NO: 7116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaaugagccauuaccaatt

SEQ ID NO: 7117 - RNA, 19 nt, Artificial Sequence
  source: /note="Description of Artificial Sequence: Synthetic oligonucleotide"
ugguaauggcucauucgga

SEQ ID NO: 7118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguaauggcucauucggatt

SEQ ID NO: 7119 - RNA, 19 nt, Artificial Sequence
  source: /note="Description of Artificial Sequence: Synthetic oligonucleotide"
uccgaaugagccauuacca

SEQ ID NO: 7120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgaaugagccauuaccatt

SEQ ID NO: 7121 - RNA, 19 nt, Artificial Sequence
  source: /note="Description of Artificial Sequence: Synthetic oligonucleotide"
gccaucaagaagguucuuc

SEQ ID NO: 7122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaucaagaagguucuuctt

SEQ ID NO: 7123 - RNA, 19 nt, Artificial Sequence
  source: /note="Description of Artificial Sequence: Synthetic oligonucleotide"
gaagaaccuucuugauggc

SEQ ID NO: 7124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaaccuucuugauggctt

SEQ ID NO: 7125 - RNA, 19 nt, Artificial Sequence
  source: /note="Description of Artificial Sequence: Synthetic oligonucleotide"
ucaagaagguucuucagga

SEQ ID NO: 7126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagaagguucuucaggatt

SEQ ID NO: 7127 - RNA, 19 nt, Artificial Sequence
  source: /note="Description of Artificial Sequence: Synthetic oligonucleotide"
uccugaagaaccuucuuga

SEQ ID NO: 7128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugaagaaccuucuugatt

SEQ ID NO: 7129 - RNA, 19 nt, Artificial Sequence
  source: /note="Description of Artificial Sequence: Synthetic oligonucleotide"
caagaagguucuucaggac

SEQ ID NO: 7130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagaagguucuucaggactt

SEQ ID NO: 7131 - RNA, 19 nt, Artificial Sequence
  source: /note="Description of Artificial Sequence: Synthetic oligonucleotide"
guccugaagaaccuucuug

SEQ ID NO: 7132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccugaagaaccuucuugtt

SEQ ID NO: 7133 - RNA, 19 nt, Artificial Sequence
  source: /note="Description of Artificial Sequence: Synthetic oligonucleotide"
agaagguucuucaggacaa

SEQ ID NO: 7134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagguucuucaggacaatt

SEQ ID NO: 7135 - RNA, 19 nt, Artificial Sequence
  source: /note="Description of Artificial Sequence: Synthetic oligonucleotide"
uuguccugaagaaccuucu

SEQ ID NO: 7136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccugaagaaccuucutt

SEQ ID NO: 7137 - RNA, 19 nt, Artificial Sequence
  source: /note="Description of Artificial Sequence: Synthetic oligonucleotide"
gaagguucuucaggacaaa

SEQ ID NO: 7138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagguucuucaggacaaatt

SEQ ID NO: 7139 - RNA, 19 nt, Artificial Sequence
  source: /note="Description of Artificial Sequence: Synthetic oligonucleotide"
uuuguccugaagaaccuuc

SEQ ID NO: 7140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuguccugaagaaccuuctt

SEQ ID NO: 7141 - RNA, 19 nt, Artificial Sequence
  source: /note="Description of Artificial Sequence: Synthetic oligonucleotide"
gguucuucaggacaaaagg

SEQ ID NO: 7142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucuucaggacaaaaggtt

SEQ ID NO: 7143 - RNA, 19 nt, Artificial Sequence
  source: /note="Description of Artificial Sequence: Synthetic oligonucleotide"
ccuuuuguccugaagaacc

SEQ ID NO: 7144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuuguccugaagaacctt

SEQ ID NO: 7145 - RNA, 19 nt, Artificial Sequence
  source: /note="Description of Artificial Sequence: Synthetic oligonucleotide"
guucuucaggacaaaaggu

SEQ ID NO: 7146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuucaggacaaaaggutt

SEQ ID NO: 7147 - RNA, 19 nt, Artificial Sequence
  source: /note="Description of Artificial Sequence: Synthetic oligonucleotide"
accuuuuguccugaagaac

SEQ ID NO: 7148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuuuguccugaagaactt

SEQ ID NO: 7149 - RNA, 19 nt, Artificial Sequence
  source: /note="Description of Artificial Sequence: Synthetic oligonucleotide"
uucuucaggacaaaagguu

SEQ ID NO: 7150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuucaggacaaaagguutt

SEQ ID NO: 7151 - RNA, 19 nt, Artificial Sequence
  source: /note="Description of Artificial Sequence: Synthetic oligonucleotide"
aaccuuuuguccugaagaa

SEQ ID NO: 7152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccuuuuguccugaagaatt

SEQ ID NO: 7153 - RNA, 19 nt, Artificial Sequence
  source: /note="Description of Artificial Sequence: Synthetic oligonucleotide"
ucuucaggacaaaagguuc

SEQ ID NO: 7154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucaggacaaaagguuctt

SEQ ID NO: 7155 - RNA, 19 nt, Artificial Sequence
  source: /note="Description of Artificial Sequence: Synthetic oligonucleotide"
gaaccuuuuguccugaaga

SEQ ID NO: 7156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccuuuuguccugaagatt

SEQ ID NO: 7157 - RNA, 19 nt, Artificial Sequence
  source: /note="Description of Artificial Sequence: Synthetic oligonucleotide"
cuucaggacaaaagguuca

SEQ ID NO: 7158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaggacaaaagguucatt

SEQ ID NO: 7159 - RNA, 19 nt, Artificial Sequence
  source: /note="Description of Artificial Sequence: Synthetic oligonucleotide"
ugaaccuuuuguccugaag

SEQ ID NO: 7160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaccuuuuguccugaagtt

SEQ ID NO: 7161 - RNA, 19 nt, Artificial Sequence
  source: /note="Description of Artificial Sequence: Synthetic oligonucleotide"
uucaggacaaaagguucaa

SEQ ID NO: 7162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaggacaaaagguucaatt

SEQ ID NO: 7163 - RNA, 19 nt, Artificial Sequence
  source: /note="Description of Artificial Sequence: Synthetic oligonucleotide"
uugaaccuuuuguccugaa

SEQ ID NO: 7164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaaccuuuuguccugaatt

SEQ ID NO: 7165 - RNA, 19 nt, Artificial Sequence
  source: /note="Description of Artificial Sequence: Synthetic oligonucleotide"
ucaggacaaaagguucaag

SEQ ID NO: 7166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaggacaaaagguucaagtt

SEQ ID NO: 7167 - RNA, 19 nt, Artificial Sequence
  source: /note="Description of Artificial Sequence: Synthetic oligonucleotide"
cuugaaccuuuuguccuga

SEQ ID NO: 7168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaaccuuuuguccugatt

SEQ ID NO: 7169 - RNA, 19 nt, Artificial Sequence
  source: /note="Description of Artificial Sequence: Synthetic oligonucleotide"
caggacaaaagguucaaga

SEQ ID NO: 7170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggacaaaagguucaagatt

SEQ ID NO: 7171 - RNA, 19 nt, Artificial Sequence
  source: /note="Description of Artificial Sequence: Synthetic oligonucleotide"
ucuugaaccuuuuguccug

SEQ ID NO: 7172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuugaaccuuuuguccugtt

SEQ ID NO: 7173 - RNA, 19 nt, Artificial Sequence
  source: /note="Description of Artificial Sequence: Synthetic oligonucleotide"
uaagcuggaccacugcaau

SEQ ID NO: 7174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagcuggaccacugcaautt

SEQ ID NO: 7175 - RNA, 19 nt, Artificial Sequence
  source: /note="Description of Artificial Sequence: Synthetic oligonucleotide"
auugcagugguccagcuua

SEQ ID NO: 7176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugcagugguccagcuuatt

SEQ ID NO: 7177 - RNA, 19 nt, Artificial Sequence
  source: /note="Description of Artificial Sequence: Synthetic oligonucleotide"
aagcuggaccacugcaaua

SEQ ID NO: 7178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuggaccacugcaauatt

SEQ ID NO: 7179 - RNA, 19 nt, Artificial Sequence
  source: /note="Description of Artificial Sequence: Synthetic oligonucleotide"
uauugcagugguccagcuu

SEQ ID NO: 7180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauugcagugguccagcuutt

SEQ ID NO: 7181 - RNA, 19 nt, Artificial Sequence
  source: /note="Description of Artificial Sequence: Synthetic oligonucleotide"
gcuggaccacugcaauauu

SEQ ID NO: 7182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggaccacugcaauauutt

SEQ ID NO: 7183 - RNA, 19 nt, Artificial Sequence
  source: /note="Description of Artificial Sequence: Synthetic oligonucleotide"
aauauugcagugguccagc

SEQ ID NO: 7184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauauugcagugguccagctt

SEQ ID NO: 7185 - RNA, 19 nt, Artificial Sequence
  source: /note="Description of Artificial Sequence: Synthetic oligonucleotide"
cuggaccacugcaauauug

SEQ ID NO: 7186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaccacugcaauauugtt

SEQ ID NO: 7187 - RNA, 19 nt, Artificial Sequence
  source: /note="Description of Artificial Sequence: Synthetic oligonucleotide"
caauauugcagugguccag

SEQ ID NO: 7188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauauugcagugguccagtt

SEQ ID NO: 7189 - RNA, 19 nt, Artificial Sequence
  source: /note="Description of Artificial Sequence: Synthetic oligonucleotide"
uggaccacugcaauauugu

SEQ ID NO: 7190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaccacugcaauauugutt

SEQ ID NO: 7191 - RNA, 19 nt, Artificial Sequence
  source: /note="Description of Artificial Sequence: Synthetic oligonucleotide"
acaauauugcaguggucca

SEQ ID NO: 7192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaauauugcagugguccatt

SEQ ID NO: 7193 - RNA, 19 nt, Artificial Sequence
  source: /note="Description of Artificial Sequence: Synthetic oligonucleotide"
ggaccacugcaauauugug

SEQ ID NO: 7194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccacugcaauauugugtt

SEQ ID NO: 7195 - RNA, 19 nt, Artificial Sequence
  source: /note="Description of Artificial Sequence: Synthetic oligonucleotide"
cacaauauugcaguggucc

SEQ ID NO: 7196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaauauugcaguggucctt

SEQ ID NO: 7197 - RNA, 19 nt, Artificial Sequence
  source: /note="Description of Artificial Sequence: Synthetic oligonucleotide"
accacugcaauauugugag

SEQ ID NO: 7198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacugcaauauugugagtt

SEQ ID NO: 7199 - RNA, 19 nt, Artificial Sequence
  source: /note="Description of Artificial Sequence: Synthetic oligonucleotide"
cucacaauauugcaguggu

SEQ ID NO: 7200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucacaauauugcaguggutt

SEQ ID NO: 7201 - RNA, 19 nt, Artificial Sequence
  source: /note="Description of Artificial Sequence: Synthetic oligonucleotide"
cacugcaauauugugaggc

SEQ ID NO: 7202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugcaauauugugaggctt

SEQ ID NO: 7203 - RNA, 19 nt, Artificial Sequence
  source: /note="Description of Artificial Sequence: Synthetic oligonucleotide"
gccucacaauauugcagug

SEQ ID NO: 7204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucacaauauugcagugtt

SEQ ID NO: 7205 - RNA, 19 nt, Artificial Sequence
  source: /note="Description of Artificial Sequence: Synthetic oligonucleotide"
cugcaauauugugaggcug

SEQ ID NO: 7206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcaauauugugaggcugtt

SEQ ID NO: 7207 - RNA, 19 nt, Artificial Sequence
  source: /note="Description of Artificial Sequence: Synthetic oligonucleotide"
cagccucacaauauugcag

SEQ ID NO: 7208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccucacaauauugcagtt

SEQ ID NO: 7209 - RNA, 19 nt, Artificial Sequence
  source: /note="Description of Artificial Sequence: Synthetic oligonucleotide"
ugcaauauugugaggcugc

SEQ ID NO: 7210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaauauugugaggcugctt

SEQ ID NO: 7211 - RNA, 19 nt, Artificial Sequence
  source: /note="Description of Artificial Sequence: Synthetic oligonucleotide"
gcagccucacaauauugca

SEQ ID NO: 7212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagccucacaauauugcatt

SEQ ID NO: 7213 - RNA, 19 nt, Artificial Sequence
  source: /note="Description of Artificial Sequence: Synthetic oligonucleotide"
gguacuuuuucuacuccag

SEQ ID NO: 7214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacuuuuucuacuccagtt

SEQ ID NO: 7215 - RNA, 19 nt, Artificial Sequence
  source: /note="Description of Artificial Sequence: Synthetic oligonucleotide"
cuggaguagaaaaaguacc

SEQ ID NO: 7216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaguagaaaaaguacctt

SEQ ID NO: 7217 - RNA, 19 nt, Artificial Sequence
  source: /note="Description of Artificial Sequence: Synthetic oligonucleotide"
uacuuuuucuacuccagug

SEQ ID NO: 7218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuuuuucuacuccagugtt

SEQ ID NO: 7219 - RNA, 19 nt, Artificial Sequence
  source: /note="Description of Artificial Sequence: Synthetic oligonucleotide"
cacuggaguagaaaaagua

SEQ ID NO: 7220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuggaguagaaaaaguatt

SEQ ID NO: 7221 - RNA, 19 nt, Artificial Sequence
  source: /note="Description of Artificial Sequence: Synthetic oligonucleotide"
acuuuuucuacuccagugg

SEQ ID NO: 7222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuuuucuacuccaguggtt

SEQ ID NO: 7223 - RNA, 19 nt, Artificial Sequence
  source: /note="Description of Artificial Sequence: Synthetic oligonucleotide"
ccacuggaguagaaaaagu

SEQ ID NO: 7224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuggaguagaaaaagutt

SEQ ID NO: 7225 - RNA, 19 nt, Artificial Sequence
  source: /note="Description of Artificial Sequence: Synthetic oligonucleotide"
uuuuucuacuccagugggg

SEQ ID NO: 7226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuucuacuccaguggggtt

SEQ ID NO: 7227 - RNA, 19 nt, Artificial Sequence
  source: /note="Description of Artificial Sequence: Synthetic oligonucleotide"
ccccacuggaguagaaaaa

SEQ ID NO: 7228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccacuggaguagaaaaatt

SEQ ID NO: 7229 - RNA, 19 nt, Artificial Sequence
  source: /note="Description of Artificial Sequence: Synthetic oligonucleotide"
uacuccaguggggagaaga

SEQ ID NO: 7230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccaguggggagaagatt

SEQ ID NO: 7231 - RNA, 19 nt, Artificial Sequence
  source: /note="Description of Artificial Sequence: Synthetic oligonucleotide"
ucuucuccccacuggagua

SEQ ID NO: 7232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucuccccacuggaguatt

SEQ ID NO: 7233 - RNA, 19 nt, Artificial Sequence
  source: /note="Description of Artificial Sequence: Synthetic oligonucleotide"
acuccaguggggagaagaa

SEQ ID NO: 7234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccaguggggagaagaatt

SEQ ID NO: 7235 - RNA, 19 nt, Artificial Sequence
  source: /note="Description of Artificial Sequence: Synthetic oligonucleotide"
uucuucuccccacuggagu

SEQ ID NO: 7236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuucuccccacuggagutt

SEQ ID NO: 7237 - RNA, 19 nt, Artificial Sequence
  source: /note="Description of Artificial Sequence: Synthetic oligonucleotide"
guggggagaagaaggacga

SEQ ID NO: 7238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggggagaagaaggacgatt

SEQ ID NO: 7239 - RNA, 19 nt, Artificial Sequence
  source: /note="Description of Artificial Sequence: Synthetic oligonucleotide"
ucguccuucuucuccccac

SEQ ID NO: 7240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucguccuucuucuccccactt

SEQ ID NO: 7241 - RNA, 19 nt, Artificial Sequence
  source: /note="Description of Artificial Sequence: Synthetic oligonucleotide"
uggggagaagaaggacgag

SEQ ID NO: 7242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggagaagaaggacgagtt

SEQ ID NO: 7243 - RNA, 19 nt, Artificial Sequence
  source: /note="Description of Artificial Sequence: Synthetic oligonucleotide"
cucguccuucuucucccca

SEQ ID NO: 7244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucguccuucuucuccccatt

SEQ ID NO: 7245 - RNA, 19 nt, Artificial Sequence
  source: /note="Description of Artificial Sequence: Synthetic oligonucleotide"
gcuguauuugaaucuggug

SEQ ID NO: 7246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguauuugaaucuggugtt

SEQ ID NO: 7247 - RNA, 19 nt, Artificial Sequence
  source: /note="Description of Artificial Sequence: Synthetic oligonucleotide"
caccagauucaaauacagc

SEQ ID NO: 7248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccagauucaaauacagctt

SEQ ID NO: 7249 - RNA, 19 nt, Artificial Sequence
  source: /note="Description of Artificial Sequence: Synthetic oligonucleotide"
cuguauuugaaucuggugc

SEQ ID NO: 7250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguauuugaaucuggugctt

SEQ ID NO: 7251 - RNA, 19 nt, Artificial Sequence
  source: /note="Description of Artificial Sequence: Synthetic oligonucleotide"
gcaccagauucaaauacag

SEQ ID NO: 7252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaccagauucaaauacagtt

SEQ ID NO: 7253 - RNA, 19 nt, Artificial Sequence
  source: /note="Description of Artificial Sequence: Synthetic oligonucleotide"
guauuugaaucuggugcug

SEQ ID NO: 7254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauuugaaucuggugcugtt

SEQ ID NO: 7255 - RNA, 19 nt, Artificial Sequence
  source: /note="Description of Artificial Sequence: Synthetic oligonucleotide"
cagcaccagauucaaauac

SEQ ID NO: 7256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaccagauucaaauactt

SEQ ID NO: 7257 - RNA, 19 nt, Artificial Sequence
  source: /note="Description of Artificial Sequence: Synthetic oligonucleotide"
uuugaaucuggugcuggag

SEQ ID NO: 7258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaaucuggugcuggagtt

SEQ ID NO: 7259 - RNA, 19 nt, Artificial Sequence
  source: /note="Description of Artificial Sequence: Synthetic oligonucleotide"
cuccagcaccagauucaaa

SEQ ID NO: 7260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccagcaccagauucaaatt

SEQ ID NO: 7261 - RNA, 19 nt, Artificial Sequence
  source: /note="Description of Artificial Sequence: Synthetic oligonucleotide"
aaucuggugcuggaguaug

SEQ ID NO: 7262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucuggugcuggaguaugtt

SEQ ID NO: 7263 - RNA, 19 nt, Artificial Sequence
  source: /note="Description of Artificial Sequence: Synthetic oligonucleotide"
cauacuccagcaccagauu

SEQ ID NO: 7264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauacuccagcaccagauutt

SEQ ID NO: 7265 - RNA, 19 nt, Artificial Sequence
  source: /note="Description of Artificial Sequence: Synthetic oligonucleotide"
uggugcuggaguaugugcc

SEQ ID NO: 7266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugcuggaguaugugcctt

SEQ ID NO: 7267 - RNA, 19 nt, Artificial Sequence
  source: /note="Description of Artificial Sequence: Synthetic oligonucleotide"
ggcacauacuccagcacca

SEQ ID NO: 7268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacauacuccagcaccatt

SEQ ID NO: 7269 - RNA, 19 nt, Artificial Sequence
  source: /note="Description of Artificial Sequence: Synthetic oligonucleotide"
ggugcuggaguaugugccc

SEQ ID NO: 7270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugcuggaguaugugccctt

SEQ ID NO: 7271 - RNA, 19 nt, Artificial Sequence
  source: /note="Description of Artificial Sequence: Synthetic oligonucleotide"
gggcacauacuccagcacc

SEQ ID NO: 7272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcacauacuccagcacctt

SEQ ID NO: 7273 - RNA, 19 nt, Artificial Sequence
  source: /note="Description of Artificial Sequence: Synthetic oligonucleotide"
gugcuggaguaugugcccg

SEQ ID NO: 7274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcuggaguaugugcccgtt

SEQ ID NO: 7275 - RNA, 19 nt, Artificial Sequence
  source: /note="Description of Artificial Sequence: Synthetic oligonucleotide"
cgggcacauacuccagcac

SEQ ID NO: 7276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcacauacuccagcactt

SEQ ID NO: 7277 - RNA, 19 nt, Artificial Sequence
  source: /note="Description of Artificial Sequence: Synthetic oligonucleotide"
ugcuggaguaugugcccga

SEQ ID NO: 7278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuggaguaugugcccgatt

SEQ ID NO: 7279 - RNA, 19 nt, Artificial Sequence
  source: /note="Description of Artificial Sequence: Synthetic oligonucleotide"
ucgggcacauacuccagca

SEQ ID NO: 7280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgggcacauacuccagcatt

SEQ ID NO: 7281 - RNA, 19 nt, Artificial Sequence
  source: /note="Description of Artificial Sequence: Synthetic oligonucleotide"
gcuggaguaugugcccgag

SEQ ID NO: 7282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggaguaugugcccgagtt

SEQ ID NO: 7283 - RNA, 19 nt, Artificial Sequence
  source: /note="Description of Artificial Sequence: Synthetic oligonucleotide"
cucgggcacauacuccagc

SEQ ID NO: 7284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgggcacauacuccagctt

SEQ ID NO: 7285 - RNA, 19 nt, Artificial Sequence
  source: /note="Description of Artificial Sequence: Synthetic oligonucleotide"
cuggaguaugugcccgaga

SEQ ID NO: 7286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaguaugugcccgagatt

SEQ ID NO: 7287 - RNA, 19 nt, Artificial Sequence
  source: /note="Description of Artificial Sequence: Synthetic oligonucleotide"
ucucgggcacauacuccag

SEQ ID NO: 7288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgggcacauacuccagtt

SEQ ID NO: 7289 - RNA, 19 nt, Artificial Sequence
  source: /note="Description of Artificial Sequence: Synthetic oligonucleotide"
augugcccgagacggugua

SEQ ID NO: 7290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augugcccgagacgguguatt

SEQ ID NO: 7291 - RNA, 19 nt, Artificial Sequence
  source: /note="Description of Artificial Sequence: Synthetic oligonucleotide"
uacaccgucucgggcacau

SEQ ID NO: 7292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaccgucucgggcacautt

SEQ ID NO: 7293 - RNA, 19 nt, Artificial Sequence
  source: /note="Description of Artificial Sequence: Synthetic oligonucleotide"
ugugcccgagacgguguac

SEQ ID NO: 7294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugcccgagacgguguactt

SEQ ID NO: 7295 - RNA, 19 nt, Artificial Sequence
  source: /note="Description of Artificial Sequence: Synthetic oligonucleotide"
guacaccgucucgggcaca

SEQ ID NO: 7296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacaccgucucgggcacatt

SEQ ID NO: 7297 - RNA, 19 nt, Artificial Sequence
  source: /note="Description of Artificial Sequence: Synthetic oligonucleotide"
aguggcccgccacuucacc

SEQ ID NO: 7298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcccgccacuucacctt

SEQ ID NO: 7299 - RNA, 19 nt, Artificial Sequence
  source: /note="Description of Artificial Sequence: Synthetic oligonucleotide"
ggugaaguggcgggccacu

SEQ ID NO: 7300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugaaguggcgggccacutt

SEQ ID NO: 7301 - RNA, 19 nt, Artificial Sequence
  source: /note="Description of Artificial Sequence: Synthetic oligonucleotide"
guggcccgccacuucacca

SEQ ID NO: 7302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcccgccacuucaccatt

SEQ ID NO: 7303 - RNA, 19 nt, Artificial Sequence
  source: /note="Description of Artificial Sequence: Synthetic oligonucleotide"
uggugaaguggcgggccac

SEQ ID NO: 7304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugaaguggcgggccactt

SEQ ID NO: 7305 - RNA, 19 nt, Artificial Sequence
  source: /note="Description of Artificial Sequence: Synthetic oligonucleotide"
uggcccgccacuucaccaa

SEQ ID NO: 7306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcccgccacuucaccaatt

SEQ ID NO: 7307 - RNA, 19 nt, Artificial Sequence
  source: /note="Description of Artificial Sequence: Synthetic oligonucleotide"
uuggugaaguggcgggcca

SEQ ID NO: 7308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggugaaguggcgggccatt

SEQ ID NO: 7309 - RNA, 19 nt, Artificial Sequence
  source: /note="Description of Artificial Sequence: Synthetic oligonucleotide"
ggcccgccacuucaccaag

SEQ ID NO: 7310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccgccacuucaccaagtt

SEQ ID NO: 7311 - RNA, 19 nt, Artificial Sequence
  source: /note="Description of Artificial Sequence: Synthetic oligonucleotide"
cuuggugaaguggcgggcc

SEQ ID NO: 7312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggugaaguggcgggcctt

SEQ ID NO: 7313 - RNA, 19 nt, Artificial Sequence
  source: /note="Description of Artificial Sequence: Synthetic oligonucleotide"
gcccgccacuucaccaagg

SEQ ID NO: 7314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccgccacuucaccaaggtt

SEQ ID NO: 7315 - RNA, 19 nt, Artificial Sequence
  source: /note="Description of Artificial Sequence: Synthetic oligonucleotide"
ccuuggugaaguggcgggc

SEQ ID NO: 7316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuggugaaguggcgggctt

SEQ ID NO: 7317 - RNA, 19 nt, Artificial Sequence
  source: /note="Description of Artificial Sequence: Synthetic oligonucleotide"
cccgccacuucaccaaggc

SEQ ID NO: 7318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgccacuucaccaaggctt

SEQ ID NO: 7319 - RNA, 19 nt, Artificial Sequence
  source: /note="Description of Artificial Sequence: Synthetic oligonucleotide"
gccuuggugaaguggcggg

SEQ ID NO: 7320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuuggugaaguggcgggtt

SEQ ID NO: 7321 - RNA, 19 nt, Artificial Sequence
  source: /note="Description of Artificial Sequence: Synthetic oligonucleotide"
ccgccacuucaccaaggcc

SEQ ID NO: 7322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccacuucaccaaggcctt

SEQ ID NO: 7323 - RNA, 19 nt, Artificial Sequence
  source: /note="Description of Artificial Sequence: Synthetic oligonucleotide"
ggccuuggugaaguggcgg

SEQ ID NO: 7324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuuggugaaguggcggtt

SEQ ID NO: 7325 - RNA, 19 nt, Artificial Sequence
  source: /note="Description of Artificial Sequence: Synthetic oligonucleotide"
cgccacuucaccaaggcca

SEQ ID NO: 7326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccacuucaccaaggccatt

SEQ ID NO: 7327 - RNA, 19 nt, Artificial Sequence
  source: /note="Description of Artificial Sequence: Synthetic oligonucleotide"
uggccuuggugaaguggcg

SEQ ID NO: 7328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccuuggugaaguggcgtt

SEQ ID NO: 7329 - RNA, 19 nt, Artificial Sequence
  source: /note="Description of Artificial Sequence: Synthetic oligonucleotide"
gccacuucaccaaggccaa

SEQ ID NO: 7330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacuucaccaaggccaatt

SEQ ID NO: 7331 - RNA, 19 nt, Artificial Sequence
  source: /note="Description of Artificial Sequence: Synthetic oligonucleotide"
uuggccuuggugaaguggc

SEQ ID NO: 7332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggccuuggugaaguggctt

SEQ ID NO: 7333 - RNA, 19 nt, Artificial Sequence
  source: /note="Description of Artificial Sequence: Synthetic oligonucleotide"
cacuucaccaaggccaagc

SEQ ID NO: 7334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuucaccaaggccaagctt

SEQ ID NO: 7335 - RNA, 19 nt, Artificial Sequence
  source: /note="Description of Artificial Sequence: Synthetic oligonucleotide"
gcuuggccuuggugaagug

SEQ ID NO: 7336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuggccuuggugaagugtt

SEQ ID NO: 7337 - RNA, 19 nt, Artificial Sequence
  source: /note="Description of Artificial Sequence: Synthetic oligonucleotide"
cuucaccaaggccaagcug

SEQ ID NO: 7338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucaccaaggccaagcugtt

SEQ ID NO: 7339 - RNA, 19 nt, Artificial Sequence
  source: /note="Description of Artificial Sequence: Synthetic oligonucleotide"
cagcuuggccuuggugaag

SEQ ID NO: 7340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuuggccuuggugaagtt

SEQ ID NO: 7341 - RNA, 19 nt, Artificial Sequence
  source: /note="Description of Artificial Sequence: Synthetic oligonucleotide"
ucaccaaggccaagcugau

SEQ ID NO: 7342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccaaggccaagcugautt

SEQ ID NO: 7343 - RNA, 19 nt, Artificial Sequence
  source: /note="Description of Artificial Sequence: Synthetic oligonucleotide"
aucagcuuggccuugguga

SEQ ID NO: 7344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucagcuuggccuuggugatt

SEQ ID NO: 7345 - RNA, 19 nt, Artificial Sequence
  source: /note="Description of Artificial Sequence: Synthetic oligonucleotide"
guguacauguaccagcucu

SEQ ID NO: 7346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacauguaccagcucutt

SEQ ID NO: 7347 - RNA, 19 nt, Artificial Sequence
  source: /note="Description of Artificial Sequence: Synthetic oligonucleotide"
agagcugguacauguacac

SEQ ID NO: 7348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcugguacauguacactt

SEQ ID NO: 7349 - RNA, 19 nt, Artificial Sequence
  source: /note="Description of Artificial Sequence: Synthetic oligonucleotide"
guacauguaccagcucuuc

SEQ ID NO: 7350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacauguaccagcucuuctt

SEQ ID NO: 7351 - RNA, 19 nt, Artificial Sequence
  source: /note="Description of Artificial Sequence: Synthetic oligonucleotide"
gaagagcugguacauguac

SEQ ID NO: 7352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagagcugguacauguactt

SEQ ID NO: 7353 - RNA, 19 nt, Artificial Sequence
  source: /note="Description of Artificial Sequence: Synthetic oligonucleotide"
uacauguaccagcucuucc

SEQ ID NO: 7354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacauguaccagcucuucctt

SEQ ID NO: 7355 - RNA, 19 nt, Artificial Sequence
  source: /note="Description of Artificial Sequence: Synthetic oligonucleotide"
ggaagagcugguacaugua

SEQ ID NO: 7356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagagcugguacauguatt

SEQ ID NO: 7357 - RNA, 19 nt, Artificial Sequence
  source: /note="Description of Artificial Sequence: Synthetic oligonucleotide"
acauguaccagcucuuccg

SEQ ID NO: 7358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauguaccagcucuuccgtt

SEQ ID NO: 7359 - RNA, 19 nt, Artificial Sequence
  source: /note="Description of Artificial Sequence: Synthetic oligonucleotide"
cggaagagcugguacaugu

SEQ ID NO: 7360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaagagcugguacaugutt

SEQ ID NO: 7361 - RNA, 19 nt, Artificial Sequence
  source: /note="Description of Artificial Sequence: Synthetic oligonucleotide"
cauguaccagcucuuccgg

SEQ ID NO: 7362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauguaccagcucuuccggtt

SEQ ID NO: 7363 - RNA, 19 nt, Artificial Sequence
  source: /note="Description of Artificial Sequence: Synthetic oligonucleotide"
ccggaagagcugguacaug

SEQ ID NO: 7364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggaagagcugguacaugtt

SEQ ID NO: 7365 - RNA, 19 nt, Artificial Sequence
  source: /note="Description of Artificial Sequence: Synthetic oligonucleotide"
uguaccagcucuuccggag

SEQ ID NO: 7366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaccagcucuuccggagtt

SEQ ID NO: 7367 - RNA, 19 nt, Artificial Sequence
  source: /note="Description of Artificial Sequence: Synthetic oligonucleotide"
cuccggaagagcugguaca

SEQ ID NO: 7368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggaagagcugguacatt

SEQ ID NO: 7369 - RNA, 19 nt, Artificial Sequence
  source: /note="Description of Artificial Sequence: Synthetic oligonucleotide"
guaccagcucuuccggagc

SEQ ID NO: 7370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccagcucuuccggagctt

SEQ ID NO: 7371 - RNA, 19 nt, Artificial Sequence
  source: /note="Description of Artificial Sequence: Synthetic oligonucleotide"
gcuccggaagagcugguac

SEQ ID NO: 7372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccggaagagcugguactt

SEQ ID NO: 7373 - RNA, 19 nt, Artificial Sequence
  source: /note="Description of Artificial Sequence: Synthetic oligonucleotide"
uaccagcucuuccggagcu

SEQ ID NO: 7374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccagcucuuccggagcutt

SEQ ID NO: 7375 - RNA, 19 nt, Artificial Sequence
  source: /note="Description of Artificial Sequence: Synthetic oligonucleotide"
agcuccggaagagcuggua

SEQ ID NO: 7376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuccggaagagcugguatt

SEQ ID NO: 7377 - RNA, 19 nt, Artificial Sequence
  source: /note="Description of Artificial Sequence: Synthetic oligonucleotide"
accagcucuuccggagcuu

SEQ ID NO: 7378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcucuuccggagcuutt

SEQ ID NO: 7379 - RNA, 19 nt, Artificial Sequence
  source: /note="Description of Artificial Sequence: Synthetic oligonucleotide"
aagcuccggaagagcuggu

SEQ ID NO: 7380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuccggaagagcuggutt

SEQ ID NO: 7381 - RNA, 19 nt, Artificial Sequence
  source: /note="Description of Artificial Sequence: Synthetic oligonucleotide"
ccagcucuuccggagcuug

SEQ ID NO: 7382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcucuuccggagcuugtt

SEQ ID NO: 7383 - RNA, 19 nt, Artificial Sequence
  source: /note="Description of Artificial Sequence: Synthetic oligonucleotide"
caagcuccggaagagcugg

SEQ ID NO: 7384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcuccggaagagcuggtt

SEQ ID NO: 7385 - RNA, 19 nt, Artificial Sequence
  source: /note="Description of Artificial Sequence: Synthetic oligonucleotide"
cagcucuuccggagcuugg

SEQ ID NO: 7386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcucuuccggagcuuggtt

SEQ ID NO: 7387 - RNA, 19 nt, Artificial Sequence
  source: /note="Description of Artificial Sequence: Synthetic oligonucleotide"
ccaagcuccggaagagcug

SEQ ID NO: 7388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagcuccggaagagcugtt

SEQ ID NO: 7389 - RNA, 19 nt, Artificial Sequence
  source: /note="Description of Artificial Sequence: Synthetic oligonucleotide"
agcucuuccggagcuuggc

SEQ ID NO: 7390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucuuccggagcuuggctt

SEQ ID NO: 7391 - RNA, 19 nt, Artificial Sequence
  source: /note="Description of Artificial Sequence: Synthetic oligonucleotide"
gccaagcuccggaagagcu

SEQ ID NO: 7392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaagcuccggaagagcutt

SEQ ID NO: 7393 - RNA, 19 nt, Artificial Sequence
  source: /note="Description of Artificial Sequence: Synthetic oligonucleotide"
gcucuuccggagcuuggcc

SEQ ID NO: 7394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuuccggagcuuggcctt

SEQ ID NO: 7395 - RNA, 19 nt, Artificial Sequence
  source: /note="Description of Artificial Sequence: Synthetic oligonucleotide"
ggccaagcuccggaagagc

SEQ ID NO: 7396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaagcuccggaagagctt

SEQ ID NO: 7397 - RNA, 19 nt, Artificial Sequence
  source: /note="Description of Artificial Sequence: Synthetic oligonucleotide"
ucuuccggagcuuggccua

SEQ ID NO: 7398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuccggagcuuggccuatt

SEQ ID NO: 7399 - RNA, 19 nt, Artificial Sequence
  source: /note="Description of Artificial Sequence: Synthetic oligonucleotide"
uaggccaagcuccggaaga

SEQ ID NO: 7400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggccaagcuccggaagatt

SEQ ID NO: 7401 - RNA, 19 nt, Artificial Sequence
  source: /note="Description of Artificial Sequence: Synthetic oligonucleotide"
uuccggagcuuggccuaca

SEQ ID NO: 7402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccggagcuuggccuacatt

SEQ ID NO: 7403 - RNA, 19 nt, Artificial Sequence
  source: /note="Description of Artificial Sequence: Synthetic oligonucleotide"
uguaggccaagcuccggaa

SEQ ID NO: 7404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaggccaagcuccggaatt

SEQ ID NO: 7405 - RNA, 19 nt, Artificial Sequence
  source: /note="Description of Artificial Sequence: Synthetic oligonucleotide"
uccggagcuuggccuacau

SEQ ID NO: 7406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggagcuuggccuacautt

SEQ ID NO: 7407 - RNA, 19 nt, Artificial Sequence
  source: /note="Description of Artificial Sequence: Synthetic oligonucleotide"
auguaggccaagcuccgga

SEQ ID NO: 7408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguaggccaagcuccggatt

SEQ ID NO: 7409 - RNA, 19 nt, Artificial Sequence
  source: /note="Description of Artificial Sequence: Synthetic oligonucleotide"
ccggagcuuggccuacauc

SEQ ID NO: 7410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagcuuggccuacauctt

SEQ ID NO: 7411 - RNA, 19 nt, Artificial Sequence
  source: /note="Description of Artificial Sequence: Synthetic oligonucleotide"
gauguaggccaagcuccgg

SEQ ID NO: 7412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauguaggccaagcuccggtt

SEQ ID NO: 7413 - RNA, 19 nt, Artificial Sequence
  source: /note="Description of Artificial Sequence: Synthetic oligonucleotide"
gugucaccgugacaucaag

SEQ ID NO: 7414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucaccgugacaucaagtt

SEQ ID NO: 7415 - RNA, 19 nt, Artificial Sequence
  source: /note="Description of Artificial Sequence: Synthetic oligonucleotide"
cuugaugucacggugacac

SEQ ID NO: 7416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaugucacggugacactt

SEQ ID NO: 7417 - RNA, 19 nt, Artificial Sequence
  source: /note="Description of Artificial Sequence: Synthetic oligonucleotide"
gaauuugcuuguggacccu

SEQ ID NO: 7418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauuugcuuguggacccutt

SEQ ID NO: 7419 - RNA, 19 nt, Artificial Sequence
  source: /note="Description of Artificial Sequence: Synthetic oligonucleotide"
aggguccacaagcaaauuc

SEQ ID NO: 7420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggguccacaagcaaauuctt

SEQ ID NO: 7421 - RNA, 19 nt, Artificial Sequence
  source: /note="Description of Artificial Sequence: Synthetic oligonucleotide"
uugcuuguggacccugaca

SEQ ID NO: 7422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcuuguggacccugacatt

SEQ ID NO: 7423 - RNA, 19 nt, Artificial Sequence
  source: /note="Description of Artificial Sequence: Synthetic oligonucleotide"
ugucaggguccacaagcaa

SEQ ID NO: 7424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucaggguccacaagcaatt

SEQ ID NO: 7425 - RNA, 19 nt, Artificial Sequence
  source: /note="Description of Artificial Sequence: Synthetic oligonucleotide"
ugcuuguggacccugacac

SEQ ID NO: 7426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuuguggacccugacactt

SEQ ID NO: 7427 - RNA, 19 nt, Artificial Sequence
  source: /note="Description of Artificial Sequence: Synthetic oligonucleotide"
gugucaggguccacaagca

SEQ ID NO: 7428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucaggguccacaagcatt

SEQ ID NO: 7429 - RNA, 19 nt, Artificial Sequence
  source: /note="Description of Artificial Sequence: Synthetic oligonucleotide"
gcuuguggacccugacacu

SEQ ID NO: 7430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuguggacccugacacutt

SEQ ID NO: 7431 - RNA, 19 nt, Artificial Sequence
  source: /note="Description of Artificial Sequence: Synthetic oligonucleotide"
agugucaggguccacaagc

SEQ ID NO: 7432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugucaggguccacaagctt

SEQ ID NO: 7433 - RNA, 19 nt, Artificial Sequence
  source: /note="Description of Artificial Sequence: Synthetic oligonucleotide"
uuguggacccugacacugc

SEQ ID NO: 7434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguggacccugacacugctt

SEQ ID NO: 7435 - RNA, 19 nt, Artificial Sequence
  source: /note="Description of Artificial Sequence: Synthetic oligonucleotide"
gcagugucaggguccacaa

SEQ ID NO: 7436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagugucaggguccacaatt

SEQ ID NO: 7437 - RNA, 19 nt, Artificial Sequence
  source: /note="Description of Artificial Sequence: Synthetic oligonucleotide"
acccugacacugcuguccu

SEQ ID NO: 7438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccugacacugcuguccutt

SEQ ID NO: 7439 - RNA, 19 nt, Artificial Sequence
  source: /note="Description of Artificial Sequence: Synthetic oligonucleotide"
aggacagcagugucagggu

SEQ ID NO: 7440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacagcagugucagggutt

SEQ ID NO: 7441 - RNA, 19 nt, Artificial Sequence
  source: /note="Description of Artificial Sequence: Synthetic oligonucleotide"
cugacacugcuguccucaa

SEQ ID NO: 7442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacacugcuguccucaatt

SEQ ID NO: 7443 - RNA, 19 nt, Artificial Sequence
  source: /note="Description of Artificial Sequence: Synthetic oligonucleotide"
uugaggacagcagugucag

SEQ ID NO: 7444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaggacagcagugucagtt

SEQ ID NO: 7445 - RNA, 19 nt, Artificial Sequence
  source: /note="Description of Artificial Sequence: Synthetic oligonucleotide"
agcucugcgauuuuggcag

SEQ ID NO: 7446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucugcgauuuuggcagtt

SEQ ID NO: 7447 - RNA, 19 nt, Artificial Sequence
  source: /note="Description of Artificial Sequence: Synthetic oligonucleotide"
cugccaaaaucgcagagcu

SEQ ID NO: 7448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccaaaaucgcagagcutt

SEQ ID NO: 7449 - RNA, 19 nt, Artificial Sequence
  source: /note="Description of Artificial Sequence: Synthetic oligonucleotide"
cugcgauuuuggcagugca

SEQ ID NO: 7450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcgauuuuggcagugcatt

SEQ ID NO: 7451 - RNA, 19 nt, Artificial Sequence
  source: /note="Description of Artificial Sequence: Synthetic oligonucleotide"
ugcacugccaaaaucgcag

SEQ ID NO: 7452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacugccaaaaucgcagtt

SEQ ID NO: 7453 - RNA, 19 nt, Artificial Sequence
  source: /note="Description of Artificial Sequence: Synthetic oligonucleotide"
cgauuuuggcagugcaaag

SEQ ID NO: 7454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgauuuuggcagugcaaagtt

SEQ ID NO: 7455 - RNA, 19 nt, Artificial Sequence
  source: /note="Description of Artificial Sequence: Synthetic oligonucleotide"
cuuugcacugccaaaaucg

SEQ ID NO: 7456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugcacugccaaaaucgtt

SEQ ID NO: 7457 - RNA, 19 nt, Artificial Sequence
  source: /note="Description of Artificial Sequence: Synthetic oligonucleotide"
gauuuuggcagugcaaagc

SEQ ID NO: 7458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuuuggcagugcaaagctt

SEQ ID NO: 7459 - RNA, 19 nt, Artificial Sequence
  source: /note="Description of Artificial Sequence: Synthetic oligonucleotide"
gcuuugcacugccaaaauc

SEQ ID NO: 7460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuugcacugccaaaauctt

SEQ ID NO: 7461 - RNA, 19 nt, Artificial Sequence
  source: /note="Description of Artificial Sequence: Synthetic oligonucleotide"
cagugcaaagcagcugguu

SEQ ID NO: 7462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugcaaagcagcugguutt

SEQ ID NO: 7463 - RNA, 19 nt, Artificial Sequence
  source: /note="Description of Artificial Sequence: Synthetic oligonucleotide"
aaccagcugcuuugcacug

SEQ ID NO: 7464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccagcugcuuugcacugtt

SEQ ID NO: 7465 - RNA, 19 nt, Artificial Sequence
  source: /note="Description of Artificial Sequence: Synthetic oligonucleotide"
agugcaaagcagcugguuc

SEQ ID NO: 7466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcaaagcagcugguuctt

SEQ ID NO: 7467 - RNA, 19 nt, Artificial Sequence
  source: /note="Description of Artificial Sequence: Synthetic oligonucleotide"
gaaccagcugcuuugcacu

SEQ ID NO: 7468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccagcugcuuugcacutt

SEQ ID NO: 7469 - RNA, 19 nt, Artificial Sequence
  source: /note="Description of Artificial Sequence: Synthetic oligonucleotide"
gugcaaagcagcugguucg

SEQ ID NO: 7470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcaaagcagcugguucgtt

SEQ ID NO: 7471 - RNA, 19 nt, Artificial Sequence
  source: /note="Description of Artificial Sequence: Synthetic oligonucleotide"
cgaaccagcugcuuugcac

SEQ ID NO: 7472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaaccagcugcuuugcactt

SEQ ID NO: 7473 - RNA, 19 nt, Artificial Sequence
  source: /note="Description of Artificial Sequence: Synthetic oligonucleotide"
gugggguggaccagcuugu

SEQ ID NO: 7474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugggguggaccagcuugutt

SEQ ID NO: 7475 - RNA, 19 nt, Artificial Sequence
  source: /note="Description of Artificial Sequence: Synthetic oligonucleotide"
acaagcugguccaccccac

SEQ ID NO: 7476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagcugguccaccccactt

SEQ ID NO: 7477 - RNA, 19 nt, Artificial Sequence
  source: /note="Description of Artificial Sequence: Synthetic oligonucleotide"
ugggguggaccagcuugug

SEQ ID NO: 7478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggguggaccagcuugugtt

SEQ ID NO: 7479 - RNA, 19 nt, Artificial Sequence
  source: /note="Description of Artificial Sequence: Synthetic oligonucleotide"
cacaagcugguccacccca

SEQ ID NO: 7480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaagcugguccaccccatt

SEQ ID NO: 7481 - RNA, 19 nt, Artificial Sequence
  source: /note="Description of Artificial Sequence: Synthetic oligonucleotide"
gggguggaccagcuugugg

SEQ ID NO: 7482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguggaccagcuuguggtt

SEQ ID NO: 7483 - RNA, 19 nt, Artificial Sequence
  source: /note="Description of Artificial Sequence: Synthetic oligonucleotide"
ccacaagcugguccacccc

SEQ ID NO: 7484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaagcugguccacccctt

SEQ ID NO: 7485 - RNA, 19 nt, Artificial Sequence
  source: /note="Description of Artificial Sequence: Synthetic oligonucleotide"
ggguggaccagcuugugga

SEQ ID NO: 7486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguggaccagcuuguggatt

SEQ ID NO: 7487 - RNA, 19 nt, Artificial Sequence
  source: /note="Description of Artificial Sequence: Synthetic oligonucleotide"
uccacaagcugguccaccc

SEQ ID NO: 7488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacaagcugguccaccctt

SEQ ID NO: 7489 - RNA, 19 nt, Artificial Sequence
  source: /note="Description of Artificial Sequence: Synthetic oligonucleotide"
uggaccagcuuguggagau

SEQ ID NO: 7490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaccagcuuguggagautt

SEQ ID NO: 7491 - RNA, 19 nt, Artificial Sequence
  source: /note="Description of Artificial Sequence: Synthetic oligonucleotide"
aucuccacaagcuggucca

SEQ ID NO: 7492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuccacaagcugguccatt

SEQ ID NO: 7493 - RNA, 19 nt, Artificial Sequence
  source: /note="Description of Artificial Sequence: Synthetic oligonucleotide"
ccagcuuguggagaucauc

SEQ ID NO: 7494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcuuguggagaucauctt

SEQ ID NO: 7495 - RNA, 19 nt, Artificial Sequence
  source: /note="Description of Artificial Sequence: Synthetic oligonucleotide"
gaugaucuccacaagcugg

SEQ ID NO: 7496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaucuccacaagcuggtt

SEQ ID NO: 7497 - RNA, 19 nt, Artificial Sequence
  source: /note="Description of Artificial Sequence: Synthetic oligonucleotide"
cagcuuguggagaucauca

SEQ ID NO: 7498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuuguggagaucaucatt

SEQ ID NO: 7499 - RNA, 19 nt, Artificial Sequence
  source: /note="Description of Artificial Sequence: Synthetic oligonucleotide"
ugaugaucuccacaagcug

SEQ ID NO: 7500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaugaucuccacaagcugtt

SEQ ID NO: 7501 - RNA, 19 nt, Artificial Sequence
  source: /note="Description of Artificial Sequence: Synthetic oligonucleotide"
gcuuguggagaucaucaag

SEQ ID NO: 7502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuguggagaucaucaagtt

SEQ ID NO: 7503 - RNA, 19 nt, Artificial Sequence
  source: /note="Description of Artificial Sequence: Synthetic oligonucleotide"
cuugaugaucuccacaagc

SEQ ID NO: 7504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaugaucuccacaagctt

SEQ ID NO: 7505 - RNA, 19 nt, Artificial Sequence
  source: /note="Description of Artificial Sequence: Synthetic oligonucleotide"
cuuguggagaucaucaagg

SEQ ID NO: 7506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguggagaucaucaaggtt

SEQ ID NO: 7507 - RNA, 19 nt, Artificial Sequence
  source: /note="Description of Artificial Sequence: Synthetic oligonucleotide"
ccuugaugaucuccacaag

SEQ ID NO: 7508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugaugaucuccacaagtt

SEQ ID NO: 7509 - RNA, 19 nt, Artificial Sequence
  source: /note="Description of Artificial Sequence: Synthetic oligonucleotide"
uuguggagaucaucaaggu

SEQ ID NO: 7510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguggagaucaucaaggutt

SEQ ID NO: 7511 - RNA, 19 nt, Artificial Sequence
  source: /note="Description of Artificial Sequence: Synthetic oligonucleotide"
accuugaugaucuccacaa

SEQ ID NO: 7512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuugaugaucuccacaatt

SEQ ID NO: 7513 - RNA, 19 nt, Artificial Sequence
  source: /note="Description of Artificial Sequence: Synthetic oligonucleotide"
guggagaucaucaagguac

SEQ ID NO: 7514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggagaucaucaagguactt

SEQ ID NO: 7515 - RNA, 19 nt, Artificial Sequence
  source: /note="Description of Artificial Sequence: Synthetic oligonucleotide"
guaccuugaugaucuccac

SEQ ID NO: 7516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccuugaugaucuccactt

SEQ ID NO: 7517 - RNA, 19 nt, Artificial Sequence
  source: /note="Description of Artificial Sequence: Synthetic oligonucleotide"
uggagaucaucaagguacu

SEQ ID NO: 7518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagaucaucaagguacutt

SEQ ID NO: 7519 - RNA, 19 nt, Artificial Sequence
  source: /note="Description of Artificial Sequence: Synthetic oligonucleotide"
aguaccuugaugaucucca

SEQ ID NO: 7520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaccuugaugaucuccatt

SEQ ID NO: 7521 - RNA, 19 nt, Artificial Sequence
  source: /note="Description of Artificial Sequence: Synthetic oligonucleotide"
ggagaucaucaagguacua

SEQ ID NO: 7522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaucaucaagguacuatt

SEQ ID NO: 7523 - RNA, 19 nt, Artificial Sequence
  source: /note="Description of Artificial Sequence: Synthetic oligonucleotide"
uaguaccuugaugaucucc

SEQ ID NO: 7524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguaccuugaugaucucctt

SEQ ID NO: 7525 - RNA, 19 nt, Artificial Sequence
  source: /note="Description of Artificial Sequence: Synthetic oligonucleotide"
gagaucaucaagguacuag

SEQ ID NO: 7526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaucaucaagguacuagtt

SEQ ID NO: 7527 - RNA, 19 nt, Artificial Sequence
  source: /note="Description of Artificial Sequence: Synthetic oligonucleotide"
cuaguaccuugaugaucuc

SEQ ID NO: 7528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaguaccuugaugaucuctt

SEQ ID NO: 7529 - RNA, 19 nt, Artificial Sequence
  source: /note="Description of Artificial Sequence: Synthetic oligonucleotide"
gaucaucaagguacuagga

SEQ ID NO: 7530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaucaagguacuaggatt

SEQ ID NO: 7531 - RNA, 19 nt, Artificial Sequence
  source: /note="Description of Artificial Sequence: Synthetic oligonucleotide"
uccuaguaccuugaugauc

SEQ ID NO: 7532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuaguaccuugaugauctt

SEQ ID NO: 7533 - RNA, 19 nt, Artificial Sequence
  source: /note="Description of Artificial Sequence: Synthetic oligonucleotide"
ucaucaagguacuaggaac

SEQ ID NO: 7534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucaagguacuaggaactt

SEQ ID NO: 7535 - RNA, 19 nt, Artificial Sequence
  source: /note="Description of Artificial Sequence: Synthetic oligonucleotide"
guuccuaguaccuugauga

SEQ ID NO: 7536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuccuaguaccuugaugatt

SEQ ID NO: 7537 - RNA, 19 nt, Artificial Sequence
  source: /note="Description of Artificial Sequence: Synthetic oligonucleotide"
caucaagguacuaggaacg

SEQ ID NO: 7538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagguacuaggaacgtt

SEQ ID NO: 7539 - RNA, 19 nt, Artificial Sequence
  source: /note="Description of Artificial Sequence: Synthetic oligonucleotide"
cguuccuaguaccuugaug

SEQ ID NO: 7540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguuccuaguaccuugaugtt

SEQ ID NO: 7541 - RNA, 19 nt, Artificial Sequence
  source: /note="Description of Artificial Sequence: Synthetic oligonucleotide"
gccaaccagggaacaaauc

SEQ ID NO: 7542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaaccagggaacaaauctt

SEQ ID NO: 7543 - RNA, 19 nt, Artificial Sequence
  source: /note="Description of Artificial Sequence: Synthetic oligonucleotide"
gauuuguucccugguuggc

SEQ ID NO: 7544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuuguucccugguuggctt

SEQ ID NO: 7545 - RNA, 19 nt, Artificial Sequence
  source: /note="Description of Artificial Sequence: Synthetic oligonucleotide"
caaccagggaacaaauccg

SEQ ID NO: 7546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaccagggaacaaauccgtt

SEQ ID NO: 7547 - RNA, 19 nt, Artificial Sequence
  source: /note="Description of Artificial Sequence: Synthetic oligonucleotide"
cggauuuguucccugguug

SEQ ID NO: 7548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggauuuguucccugguugtt

SEQ ID NO: 7549 - RNA, 19 nt, Artificial Sequence
  source: /note="Description of Artificial Sequence: Synthetic oligonucleotide"
accagggaacaaauccgag

SEQ ID NO: 7550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagggaacaaauccgagtt

SEQ ID NO: 7551 - RNA, 19 nt, Artificial Sequence
  source: /note="Description of Artificial Sequence: Synthetic oligonucleotide"
cucggauuuguucccuggu

SEQ ID NO: 7552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggauuuguucccuggutt

SEQ ID NO: 7553 - RNA, 19 nt, Artificial Sequence
  source: /note="Description of Artificial Sequence: Synthetic oligonucleotide"
agggaacaaauccgagaga

SEQ ID NO: 7554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaacaaauccgagagatt

SEQ ID NO: 7555 - RNA, 19 nt, Artificial Sequence
  source: /note="Description of Artificial Sequence: Synthetic oligonucleotide"
ucucucggauuuguucccu

SEQ ID NO: 7556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucucggauuuguucccutt

SEQ ID NO: 7557 - RNA, 19 nt, Artificial Sequence
  source: /note="Description of Artificial Sequence: Synthetic oligonucleotide"
ggaacaaauccgagagaug

SEQ ID NO: 7558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacaaauccgagagaugtt

SEQ ID NO: 7559 - RNA, 19 nt, Artificial Sequence
  source: /note="Description of Artificial Sequence: Synthetic oligonucleotide"
caucucucggauuuguucc

SEQ ID NO: 7560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucucucggauuuguucctt

SEQ ID NO: 7561 - RNA, 19 nt, Artificial Sequence
  source: /note="Description of Artificial Sequence: Synthetic oligonucleotide"
aaauccgagagaugaaccc

SEQ ID NO: 7562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauccgagagaugaaccctt

SEQ ID NO: 7563 - RNA, 19 nt, Artificial Sequence
  source: /note="Description of Artificial Sequence: Synthetic oligonucleotide"
ggguucaucucucggauuu

SEQ ID NO: 7564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguucaucucucggauuutt

SEQ ID NO: 7565 - RNA, 19 nt, Artificial Sequence
  source: /note="Description of Artificial Sequence: Synthetic oligonucleotide"
uccgagagaugaacccuaa

SEQ ID NO: 7566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgagagaugaacccuaatt

SEQ ID NO: 7567 - RNA, 19 nt, Artificial Sequence
  source: /note="Description of Artificial Sequence: Synthetic oligonucleotide"
uuaggguucaucucucgga

SEQ ID NO: 7568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaggguucaucucucggatt

SEQ ID NO: 7569 - RNA, 19 nt, Artificial Sequence
  source: /note="Description of Artificial Sequence: Synthetic oligonucleotide"
ccgagagaugaacccuaac

SEQ ID NO: 7570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagagaugaacccuaactt

SEQ ID NO: 7571 - RNA, 19 nt, Artificial Sequence
  source: /note="Description of Artificial Sequence: Synthetic oligonucleotide"
guuaggguucaucucucgg

SEQ ID NO: 7572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaggguucaucucucggtt

SEQ ID NO: 7573 - RNA, 19 nt, Artificial Sequence
  source: /note="Description of Artificial Sequence: Synthetic oligonucleotide"
ggaguucaaguucccccag

SEQ ID NO: 7574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguucaaguucccccagtt

SEQ ID NO: 7575 - RNA, 19 nt, Artificial Sequence
  source: /note="Description of Artificial Sequence: Synthetic oligonucleotide"
cugggggaacuugaacucc

SEQ ID NO: 7576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggggaacuugaacucctt

SEQ ID NO: 7577 - RNA, 19 nt, Artificial Sequence
  source: /note="Description of Artificial Sequence: Synthetic oligonucleotide"
gaguucaaguucccccaga

SEQ ID NO: 7578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguucaaguucccccagatt

SEQ ID NO: 7579 - RNA, 19 nt, Artificial Sequence
  source: /note="Description of Artificial Sequence: Synthetic oligonucleotide"
ucugggggaacuugaacuc

SEQ ID NO: 7580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugggggaacuugaacuctt

SEQ ID NO: 7581 - RNA, 19 nt, Artificial Sequence
  source: /note="Description of Artificial Sequence: Synthetic oligonucleotide"
aguucaaguucccccagau

SEQ ID NO: 7582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucaaguucccccagautt

SEQ ID NO: 7583 - RNA, 19 nt, Artificial Sequence
  source: /note="Description of Artificial Sequence: Synthetic oligonucleotide"
aucugggggaacuugaacu

SEQ ID NO: 7584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugggggaacuugaacutt

SEQ ID NO: 7585 - RNA, 19 nt, Artificial Sequence
  source: /note="Description of Artificial Sequence: Synthetic oligonucleotide"
guucaaguucccccagauc

SEQ ID NO: 7586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaaguucccccagauctt

SEQ ID NO: 7587 - RNA, 19 nt, Artificial Sequence
  source: /note="Description of Artificial Sequence: Synthetic oligonucleotide"
gaucugggggaacuugaac

SEQ ID NO: 7588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucugggggaacuugaactt

SEQ ID NO: 7589 - RNA, 19 nt, Artificial Sequence
  source: /note="Description of Artificial Sequence: Synthetic oligonucleotide"
uucaaguucccccagauca

SEQ ID NO: 7590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaaguucccccagaucatt

SEQ ID NO: 7591 - RNA, 19 nt, Artificial Sequence
  source: /note="Description of Artificial Sequence: Synthetic oligonucleotide"
ugaucugggggaacuugaa

SEQ ID NO: 7592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucugggggaacuugaatt

SEQ ID NO: 7593 - RNA, 19 nt, Artificial Sequence
  source: /note="Description of Artificial Sequence: Synthetic oligonucleotide"
ucaaguucccccagaucaa

SEQ ID NO: 7594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaguucccccagaucaatt

SEQ ID NO: 7595 - RNA, 19 nt, Artificial Sequence
  source: /note="Description of Artificial Sequence: Synthetic oligonucleotide"
uugaucugggggaacuuga

SEQ ID NO: 7596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaucugggggaacuugatt

SEQ ID NO: 7597 - RNA, 19 nt, Artificial Sequence
  source: /note="Description of Artificial Sequence: Synthetic oligonucleotide"
caaguucccccagaucaaa

SEQ ID NO: 7598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaguucccccagaucaaatt

SEQ ID NO: 7599 - RNA, 19 nt, Artificial Sequence
  source: /note="Description of Artificial Sequence: Synthetic oligonucleotide"
uuugaucugggggaacuug

SEQ ID NO: 7600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaucugggggaacuugtt

SEQ ID NO: 7601 - RNA, 19 nt, Artificial Sequence
  source: /note="Description of Artificial Sequence: Synthetic oligonucleotide"
aguucccccagaucaaagc

SEQ ID NO: 7602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucccccagaucaaagctt

SEQ ID NO: 7603 - RNA, 19 nt, Artificial Sequence
  source: /note="Description of Artificial Sequence: Synthetic oligonucleotide"
gcuuugaucugggggaacu

SEQ ID NO: 7604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuugaucugggggaacutt

SEQ ID NO: 7605 - RNA, 19 nt, Artificial Sequence
  source: /note="Description of Artificial Sequence: Synthetic oligonucleotide"
uucccccagaucaaagcuc

SEQ ID NO: 7606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccccagaucaaagcuctt

SEQ ID NO: 7607 - RNA, 19 nt, Artificial Sequence
  source: /note="Description of Artificial Sequence: Synthetic oligonucleotide"
gagcuuugaucugggggaa

SEQ ID NO: 7608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuuugaucugggggaatt

SEQ ID NO: 7609 - RNA, 19 nt, Artificial Sequence
  source: /note="Description of Artificial Sequence: Synthetic oligonucleotide"
ucccccagaucaaagcuca

SEQ ID NO: 7610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccccagaucaaagcucatt

SEQ ID NO: 7611 - RNA, 19 nt, Artificial Sequence
  source: /note="Description of Artificial Sequence: Synthetic oligonucleotide"
ugagcuuugaucuggggga

SEQ ID NO: 7612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagcuuugaucugggggatt

SEQ ID NO: 7613 - RNA, 19 nt, Artificial Sequence
  source: /note="Description of Artificial Sequence: Synthetic oligonucleotide"
cccagaucaaagcucaccc

SEQ ID NO: 7614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagaucaaagcucaccctt

SEQ ID NO: 7615 - RNA, 19 nt, Artificial Sequence
  source: /note="Description of Artificial Sequence: Synthetic oligonucleotide"
gggugagcuuugaucuggg

SEQ ID NO: 7616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggugagcuuugaucugggtt

SEQ ID NO: 7617 - RNA, 19 nt, Artificial Sequence
  source: /note="Description of Artificial Sequence: Synthetic oligonucleotide"
ccagaucaaagcucacccu

SEQ ID NO: 7618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaucaaagcucacccutt

SEQ ID NO: 7619 - RNA, 19 nt, Artificial Sequence
  source: /note="Description of Artificial Sequence: Synthetic oligonucleotide"
agggugagcuuugaucugg

SEQ ID NO: 7620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggugagcuuugaucuggtt

SEQ ID NO: 7621 - RNA, 19 nt, Artificial Sequence
  source: /note="Description of Artificial Sequence: Synthetic oligonucleotide"
uuggacaaagguguucaaa

SEQ ID NO: 7622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggacaaagguguucaaatt

SEQ ID NO: 7623 - RNA, 19 nt, Artificial Sequence
  source: /note="Description of Artificial Sequence: Synthetic oligonucleotide"
uuugaacaccuuuguccaa

SEQ ID NO: 7624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaacaccuuuguccaatt

SEQ ID NO: 7625 - RNA, 19 nt, Artificial Sequence
  source: /note="Description of Artificial Sequence: Synthetic oligonucleotide"
ggacaaagguguucaaauc

SEQ ID NO: 7626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaaagguguucaaauctt

SEQ ID NO: 7627 - RNA, 19 nt, Artificial Sequence
  source: /note="Description of Artificial Sequence: Synthetic oligonucleotide"
gauuugaacaccuuugucc

SEQ ID NO: 7628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuugaacaccuuugucctt

SEQ ID NO: 7629 - RNA, 19 nt, Artificial Sequence
  source: /note="Description of Artificial Sequence: Synthetic oligonucleotide"
gacaaagguguucaaaucu

SEQ ID NO: 7630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaaagguguucaaaucutt

SEQ ID NO: 7631 - RNA, 19 nt, Artificial Sequence
  source: /note="Description of Artificial Sequence: Synthetic oligonucleotide"
agauuugaacaccuuuguc

SEQ ID NO: 7632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuugaacaccuuuguctt

SEQ ID NO: 7633 - RNA, 19 nt, Artificial Sequence
  source: /note="Description of Artificial Sequence: Synthetic oligonucleotide"
acaaagguguucaaaucuu

SEQ ID NO: 7634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaagguguucaaaucuutt

SEQ ID NO: 7635 - RNA, 19 nt, Artificial Sequence
  source: /note="Description of Artificial Sequence: Synthetic oligonucleotide"
aagauuugaacaccuuugu

SEQ ID NO: 7636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagauuugaacaccuuugutt

SEQ ID NO: 7637 - RNA, 19 nt, Artificial Sequence
  source: /note="Description of Artificial Sequence: Synthetic oligonucleotide"
cgccauccucaaggcucuc

SEQ ID NO: 7638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccauccucaaggcucuctt

SEQ ID NO: 7639 - RNA, 19 nt, Artificial Sequence
  source: /note="Description of Artificial Sequence: Synthetic oligonucleotide"
gagagccuugaggauggcg

SEQ ID NO: 7640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagccuugaggauggcgtt

SEQ ID NO: 7641 - RNA, 19 nt, Artificial Sequence
  source: /note="Description of Artificial Sequence: Synthetic oligonucleotide"
cucaaggcucuccccacuc

SEQ ID NO: 7642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaaggcucuccccacuctt

SEQ ID NO: 7643 - RNA, 19 nt, Artificial Sequence
  source: /note="Description of Artificial Sequence: Synthetic oligonucleotide"
gaguggggagagccuugag

SEQ ID NO: 7644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguggggagagccuugagtt

SEQ ID NO: 7645 - RNA, 19 nt, Artificial Sequence
  source: /note="Description of Artificial Sequence: Synthetic oligonucleotide"
cgaggcuugugcccacagc

SEQ ID NO: 7646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaggcuugugcccacagctt

SEQ ID NO: 7647 - RNA, 19 nt, Artificial Sequence
  source: /note="Description of Artificial Sequence: Synthetic oligonucleotide"
gcugugggcacaagccucg

SEQ ID NO: 7648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugugggcacaagccucgtt

SEQ ID NO: 7649 - RNA, 19 nt, Artificial Sequence
  source: /note="Description of Artificial Sequence: Synthetic oligonucleotide"
gaggcuugugcccacagcu

SEQ ID NO: 7650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcuugugcccacagcutt

SEQ ID NO: 7651 - RNA, 19 nt, Artificial Sequence
  source: /note="Description of Artificial Sequence: Synthetic oligonucleotide"
agcugugggcacaagccuc

SEQ ID NO: 7652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugugggcacaagccuctt

SEQ ID NO: 7653 - RNA, 19 nt, Artificial Sequence
  source: /note="Description of Artificial Sequence: Synthetic oligonucleotide"
ggcuugugcccacagcuuc

SEQ ID NO: 7654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuugugcccacagcuuctt

SEQ ID NO: 7655 - RNA, 19 nt, Artificial Sequence
  source: /note="Description of Artificial Sequence: Synthetic oligonucleotide"
gaagcugugggcacaagcc

SEQ ID NO: 7656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcugugggcacaagcctt

SEQ ID NO: 7657 - RNA, 19 nt, Artificial Sequence
  source: /note="Description of Artificial Sequence: Synthetic oligonucleotide"
gcuugugcccacagcuucu

SEQ ID NO: 7658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugugcccacagcuucutt

SEQ ID NO: 7659 - RNA, 19 nt, Artificial Sequence
  source: /note="Description of Artificial Sequence: Synthetic oligonucleotide"
agaagcugugggcacaagc

SEQ ID NO: 7660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagcugugggcacaagctt

SEQ ID NO: 7661 - RNA, 19 nt, Artificial Sequence
  source: /note="Description of Artificial Sequence: Synthetic oligonucleotide"
cuugugcccacagcuucuu

SEQ ID NO: 7662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugugcccacagcuucuutt

SEQ ID NO: 7663 - RNA, 19 nt, Artificial Sequence
  source: /note="Description of Artificial Sequence: Synthetic oligonucleotide"
aagaagcugugggcacaag

SEQ ID NO: 7664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaagcugugggcacaagtt

SEQ ID NO: 7665 - RNA, 19 nt, Artificial Sequence
  source: /note="Description of Artificial Sequence: Synthetic oligonucleotide"
ugugcccacagcuucuucg

SEQ ID NO: 7666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugcccacagcuucuucgtt

SEQ ID NO: 7667 - RNA, 19 nt, Artificial Sequence
  source: /note="Description of Artificial Sequence: Synthetic oligonucleotide"
cgaagaagcugugggcaca

SEQ ID NO: 7668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaagaagcugugggcacatt

SEQ ID NO: 7669 - RNA, 19 nt, Artificial Sequence
  source: /note="Description of Artificial Sequence: Synthetic oligonucleotide"
agcccagcuccccaacgac

SEQ ID NO: 7670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccagcuccccaacgactt

SEQ ID NO: 7671 - RNA, 19 nt, Artificial Sequence
  source: /note="Description of Artificial Sequence: Synthetic oligonucleotide"
gucguuggggagcugggcu

SEQ ID NO: 7672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucguuggggagcugggcutt

SEQ ID NO: 7673 - RNA, 19 nt, Artificial Sequence
  source: /note="Description of Artificial Sequence: Synthetic oligonucleotide"
gcccagcuccccaacgacc

SEQ ID NO: 7674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagcuccccaacgacctt

SEQ ID NO: 7675 - RNA, 19 nt, Artificial Sequence
  source: /note="Description of Artificial Sequence: Synthetic oligonucleotide"
ggucguuggggagcugggc

SEQ ID NO: 7676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucguuggggagcugggctt

SEQ ID NO: 7677 - RNA, 19 nt, Artificial Sequence
  source: /note="Description of Artificial Sequence: Synthetic oligonucleotide"
cccagcuccccaacgaccg

SEQ ID NO: 7678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcuccccaacgaccgtt

SEQ ID NO: 7679 - RNA, 19 nt, Artificial Sequence
  source: /note="Description of Artificial Sequence: Synthetic oligonucleotide"
cggucguuggggagcuggg

SEQ ID NO: 7680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggucguuggggagcugggtt

SEQ ID NO: 7681 - RNA, 19 nt, Artificial Sequence
  source: /note="Description of Artificial Sequence: Synthetic oligonucleotide"
ccagcuccccaacgaccgc

SEQ ID NO: 7682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcuccccaacgaccgctt

SEQ ID NO: 7683 - RNA, 19 nt, Artificial Sequence
  source: /note="Description of Artificial Sequence: Synthetic oligonucleotide"
gcggucguuggggagcugg

SEQ ID NO: 7684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggucguuggggagcuggtt

SEQ ID NO: 7685 - RNA, 19 nt, Artificial Sequence
  source: /note="Description of Artificial Sequence: Synthetic oligonucleotide"
cagcuccccaacgaccgcc

SEQ ID NO: 7686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuccccaacgaccgcctt

SEQ ID NO: 7687 - RNA, 19 nt, Artificial Sequence
  source: /note="Description of Artificial Sequence: Synthetic oligonucleotide"
ggcggucguuggggagcug

SEQ ID NO: 7688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggucguuggggagcugtt

SEQ ID NO: 7689 - RNA, 19 nt, Artificial Sequence
  source: /note="Description of Artificial Sequence: Synthetic oligonucleotide"
cccccuguucaacuucagu

SEQ ID NO: 7690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccuguucaacuucagutt

SEQ ID NO: 7691 - RNA, 19 nt, Artificial Sequence
  source: /note="Description of Artificial Sequence: Synthetic oligonucleotide"
acugaaguugaacaggggg

SEQ ID NO: 7692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugaaguugaacagggggtt

SEQ ID NO: 7693 - RNA, 19 nt, Artificial Sequence
  source: /note="Description of Artificial Sequence: Synthetic oligonucleotide"
uguucaacuucaguccugg

SEQ ID NO: 7694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucaacuucaguccuggtt

SEQ ID NO: 7695 - RNA, 19 nt, Artificial Sequence
  source: /note="Description of Artificial Sequence: Synthetic oligonucleotide"
ccaggacugaaguugaaca

SEQ ID NO: 7696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggacugaaguugaacatt

SEQ ID NO: 7697 - RNA, 19 nt, Artificial Sequence
  source: /note="Description of Artificial Sequence: Synthetic oligonucleotide"
guucaacuucaguccuggu

SEQ ID NO: 7698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucaacuucaguccuggutt

SEQ ID NO: 7699 - RNA, 19 nt, Artificial Sequence
  source: /note="Description of Artificial Sequence: Synthetic oligonucleotide"
accaggacugaaguugaac

SEQ ID NO: 7700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaggacugaaguugaactt

SEQ ID NO: 7701 - RNA, 19 nt, Artificial Sequence
  source: /note="Description of Artificial Sequence: Synthetic oligonucleotide"
uucaacuucaguccuggug

SEQ ID NO: 7702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaacuucaguccuggugtt

SEQ ID NO: 7703 - RNA, 19 nt, Artificial Sequence
  source: /note="Description of Artificial Sequence: Synthetic oligonucleotide"
caccaggacugaaguugaa

SEQ ID NO: 7704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaggacugaaguugaatt

SEQ ID NO: 7705 - RNA, 19 nt, Artificial Sequence
  source: /note="Description of Artificial Sequence: Synthetic oligonucleotide"
ucaacuucaguccugguga

SEQ ID NO: 7706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaacuucaguccuggugatt

SEQ ID NO: 7707 - RNA, 19 nt, Artificial Sequence
  source: /note="Description of Artificial Sequence: Synthetic oligonucleotide"
ucaccaggacugaaguuga

SEQ ID NO: 7708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccaggacugaaguugatt

SEQ ID NO: 7709 - RNA, 19 nt, Artificial Sequence
  source: /note="Description of Artificial Sequence: Synthetic oligonucleotide"
caacuucaguccuggugaa

SEQ ID NO: 7710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacuucaguccuggugaatt

SEQ ID NO: 7711 - RNA, 19 nt, Artificial Sequence
  source: /note="Description of Artificial Sequence: Synthetic oligonucleotide"
uucaccaggacugaaguug

SEQ ID NO: 7712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaccaggacugaaguugtt

SEQ ID NO: 7713 - RNA, 19 nt, Artificial Sequence
  source: /note="Description of Artificial Sequence: Synthetic oligonucleotide"
aaugccauucucaucccuc

SEQ ID NO: 7714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugccauucucaucccuctt

SEQ ID NO: 7715 - RNA, 19 nt, Artificial Sequence
  source: /note="Description of Artificial Sequence: Synthetic oligonucleotide"
gagggaugagaauggcauu

SEQ ID NO: 7716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaugagaauggcauutt

SEQ ID NO: 7717 - RNA, 19 nt, Artificial Sequence
  source: /note="Description of Artificial Sequence: Synthetic oligonucleotide"
augccauucucaucccucc

SEQ ID NO: 7718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augccauucucaucccucctt

SEQ ID NO: 7719 - RNA, 19 nt, Artificial Sequence
  source: /note="Description of Artificial Sequence: Synthetic oligonucleotide"
ggagggaugagaauggcau

SEQ ID NO: 7720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagggaugagaauggcautt

SEQ ID NO: 7721 - RNA, 19 nt, Artificial Sequence
  source: /note="Description of Artificial Sequence: Synthetic oligonucleotide"
ugccauucucaucccuccu

SEQ ID NO: 7722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccauucucaucccuccutt

SEQ ID NO: 7723 - RNA, 19 nt, Artificial Sequence
  source: /note="Description of Artificial Sequence: Synthetic oligonucleotide"
aggagggaugagaauggca

SEQ ID NO: 7724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggagggaugagaauggcatt

SEQ ID NO: 7725 - RNA, 19 nt, Artificial Sequence
  source: /note="Description of Artificial Sequence: Synthetic oligonucleotide"
gccauucucaucccuccuc

SEQ ID NO: 7726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccauucucaucccuccuctt

SEQ ID NO: 7727 - RNA, 19 nt, Artificial Sequence
  source: /note="Description of Artificial Sequence: Synthetic oligonucleotide"
gaggagggaugagaauggc

SEQ ID NO: 7728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggagggaugagaauggctt

SEQ ID NO: 7729 - RNA, 19 nt, Artificial Sequence
  source: /note="Description of Artificial Sequence: Synthetic oligonucleotide"
ccauucucaucccuccuca

SEQ ID NO: 7730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauucucaucccuccucatt

SEQ ID NO: 7731 - RNA, 19 nt, Artificial Sequence
  source: /note="Description of Artificial Sequence: Synthetic oligonucleotide"
ugaggagggaugagaaugg

SEQ ID NO: 7732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggagggaugagaauggtt

SEQ ID NO: 7733 - RNA, 19 nt, Artificial Sequence
  source: /note="Description of Artificial Sequence: Synthetic oligonucleotide"
cauucucaucccuccucac

SEQ ID NO: 7734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauucucaucccuccucactt

SEQ ID NO: 7735 - RNA, 19 nt, Artificial Sequence
  source: /note="Description of Artificial Sequence: Synthetic oligonucleotide"
gugaggagggaugagaaug

SEQ ID NO: 7736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaggagggaugagaaugtt

SEQ ID NO: 7737 - RNA, 19 nt, Artificial Sequence
  source: /note="Description of Artificial Sequence: Synthetic oligonucleotide"
auucucaucccuccucacu

SEQ ID NO: 7738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucucaucccuccucacutt

SEQ ID NO: 7739 - RNA, 19 nt, Artificial Sequence
  source: /note="Description of Artificial Sequence: Synthetic oligonucleotide"
agugaggagggaugagaau

SEQ ID NO: 7740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugaggagggaugagaautt

SEQ ID NO: 7741 - RNA, 19 nt, Artificial Sequence
  source: /note="Description of Artificial Sequence: Synthetic oligonucleotide"
uucucaucccuccucacuu

SEQ ID NO: 7742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucaucccuccucacuutt

SEQ ID NO: 7743 - RNA, 19 nt, Artificial Sequence
  source: /note="Description of Artificial Sequence: Synthetic oligonucleotide"
aagugaggagggaugagaa

SEQ ID NO: 7744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagugaggagggaugagaatt

SEQ ID NO: 7745 - RNA, 19 nt, Artificial Sequence
  source: /note="Description of Artificial Sequence: Synthetic oligonucleotide"
ucucaucccuccucacuug

SEQ ID NO: 7746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucaucccuccucacuugtt

SEQ ID NO: 7747 - RNA, 19 nt, Artificial Sequence
  source: /note="Description of Artificial Sequence: Synthetic oligonucleotide"
caagugaggagggaugaga

SEQ ID NO: 7748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagugaggagggaugagatt

SEQ ID NO: 7749 - RNA, 19 nt, Artificial Sequence
  source: /note="Description of Artificial Sequence: Synthetic oligonucleotide"
aucccuccucacuugaggu

SEQ ID NO: 7750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucccuccucacuugaggutt

SEQ ID NO: 7751 - RNA, 19 nt, Artificial Sequence
  source: /note="Description of Artificial Sequence: Synthetic oligonucleotide"
accucaagugaggagggau

SEQ ID NO: 7752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucaagugaggagggautt

SEQ ID NO: 7753 - RNA, 19 nt, Artificial Sequence
  source: /note="Description of Artificial Sequence: Synthetic oligonucleotide"
ucccuccucacuugagguc

SEQ ID NO: 7754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuccucacuugagguctt

SEQ ID NO: 7755 - RNA, 19 nt, Artificial Sequence
  source: /note="Description of Artificial Sequence: Synthetic oligonucleotide"
gaccucaagugaggaggga

SEQ ID NO: 7756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccucaagugaggagggatt

SEQ ID NO: 7757 - RNA, 19 nt, Artificial Sequence
  source: /note="Description of Artificial Sequence: Synthetic oligonucleotide"
uccucacuugaggucccca

SEQ ID NO: 7758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucacuugagguccccatt

SEQ ID NO: 7759 - RNA, 19 nt, Artificial Sequence
  source: /note="Description of Artificial Sequence: Synthetic oligonucleotide"
uggggaccucaagugagga

SEQ ID NO: 7760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggaccucaagugaggatt

SEQ ID NO: 7761 - RNA, 19 nt, Artificial Sequence
  source: /note="Description of Artificial Sequence: Synthetic oligonucleotide"
cucacuugagguccccagc

SEQ ID NO: 7762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucacuugagguccccagctt

SEQ ID NO: 7763 - RNA, 19 nt, Artificial Sequence
  source: /note="Description of Artificial Sequence: Synthetic oligonucleotide"
gcuggggaccucaagugag

SEQ ID NO: 7764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggggaccucaagugagtt

SEQ ID NO: 7765 - RNA, 19 nt, Artificial Sequence
  source: /note="Description of Artificial Sequence: Synthetic oligonucleotide"
ucacuugagguccccagca

SEQ ID NO: 7766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacuugagguccccagcatt

SEQ ID NO: 7767 - RNA, 19 nt, Artificial Sequence
  source: /note="Description of Artificial Sequence: Synthetic oligonucleotide"
ugcuggggaccucaaguga

SEQ ID NO: 7768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuggggaccucaagugatt

SEQ ID NO: 7769 - RNA, 19 nt, Artificial Sequence
  source: /note="Description of Artificial Sequence: Synthetic oligonucleotide"
cacuugagguccccagcag

SEQ ID NO: 7770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuugagguccccagcagtt

SEQ ID NO: 7771 - RNA, 19 nt, Artificial Sequence
  source: /note="Description of Artificial Sequence: Synthetic oligonucleotide"
cugcuggggaccucaagug

SEQ ID NO: 7772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuggggaccucaagugtt

SEQ ID NO: 7773 - RNA, 19 nt, Artificial Sequence
  source: /note="Description of Artificial Sequence: Synthetic oligonucleotide"
ugagguccccagcaggccc

SEQ ID NO: 7774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagguccccagcaggccctt

SEQ ID NO: 7775 - RNA, 19 nt, Artificial Sequence
  source: /note="Description of Artificial Sequence: Synthetic oligonucleotide"
gggccugcuggggaccuca

SEQ ID NO: 7776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccugcuggggaccucatt

SEQ ID NO: 7777 - RNA, 19 nt, Artificial Sequence
  source: /note="Description of Artificial Sequence: Synthetic oligonucleotide"
gagguccccagcaggcccu

SEQ ID NO: 7778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagguccccagcaggcccutt

SEQ ID NO: 7779 - RNA, 19 nt, Artificial Sequence
  source: /note="Description of Artificial Sequence: Synthetic oligonucleotide"
agggccugcuggggaccuc

SEQ ID NO: 7780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggccugcuggggaccuctt

SEQ ID NO: 7781 - RNA, 19 nt, Artificial Sequence
  source: /note="Description of Artificial Sequence: Synthetic oligonucleotide"
gcaggcccugcuucucccc

SEQ ID NO: 7782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaggcccugcuucucccctt

SEQ ID NO: 7783 - RNA, 19 nt, Artificial Sequence
  source: /note="Description of Artificial Sequence: Synthetic oligonucleotide"
ggggagaagcagggccugc

SEQ ID NO: 7784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggagaagcagggccugctt

SEQ ID NO: 7785 - RNA, 19 nt, Artificial Sequence
  source: /note="Description of Artificial Sequence: Synthetic oligonucleotide"
auccucacaagcuuuaacu

SEQ ID NO: 7786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccucacaagcuuuaacutt

SEQ ID NO: 7787 - RNA, 19 nt, Artificial Sequence
  source: /note="Description of Artificial Sequence: Synthetic oligonucleotide"
aguuaaagcuugugaggau

SEQ ID NO: 7788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuaaagcuugugaggautt

SEQ ID NO: 7789 - RNA, 19 nt, Artificial Sequence
  source: /note="Description of Artificial Sequence: Synthetic oligonucleotide"
uccucacaagcuuuaacug

SEQ ID NO: 7790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucacaagcuuuaacugtt

SEQ ID NO: 7791 - RNA, 19 nt, Artificial Sequence
  source: /note="Description of Artificial Sequence: Synthetic oligonucleotide"
caguuaaagcuugugagga

SEQ ID NO: 7792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguuaaagcuugugaggatt

SEQ ID NO: 7793 - RNA, 19 nt, Artificial Sequence
  source: /note="Description of Artificial Sequence: Synthetic oligonucleotide"
ccucacaagcuuuaacuga

SEQ ID NO: 7794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucacaagcuuuaacugatt

SEQ ID NO: 7795 - RNA, 19 nt, Artificial Sequence
  source: /note="Description of Artificial Sequence: Synthetic oligonucleotide"
ucaguuaaagcuugugagg

SEQ ID NO: 7796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguuaaagcuugugaggtt

SEQ ID NO: 7797 - RNA, 19 nt, Artificial Sequence
  source: /note="Description of Artificial Sequence: Synthetic oligonucleotide"
cacaagcuuuaacugaagc

SEQ ID NO: 7798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaagcuuuaacugaagctt

SEQ ID NO: 7799 - RNA, 19 nt, Artificial Sequence
  source: /note="Description of Artificial Sequence: Synthetic oligonucleotide"
gcuucaguuaaagcuugug

SEQ ID NO: 7800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuucaguuaaagcuugugtt

SEQ ID NO: 7801 - RNA, 19 nt, Artificial Sequence
  source: /note="Description of Artificial Sequence: Synthetic oligonucleotide"
gcuuuaacugaagcucaga

SEQ ID NO: 7802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuuaacugaagcucagatt

SEQ ID NO: 7803 - RNA, 19 nt, Artificial Sequence
  source: /note="Description of Artificial Sequence: Synthetic oligonucleotide"
ucugagcuucaguuaaagc

SEQ ID NO: 7804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugagcuucaguuaaagctt

SEQ ID NO: 7805 - RNA, 19 nt, Artificial Sequence
  source: /note="Description of Artificial Sequence: Synthetic oligonucleotide"
ccaucugaugccacaacug

SEQ ID NO: 7806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucugaugccacaacugtt

SEQ ID NO: 7807 - RNA, 19 nt, Artificial Sequence
  source: /note="Description of Artificial Sequence: Synthetic oligonucleotide"
caguuguggcaucagaugg

SEQ ID NO: 7808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguuguggcaucagauggtt

SEQ ID NO: 7809 - RNA, 19 nt, Artificial Sequence
  source: /note="Description of Artificial Sequence: Synthetic oligonucleotide"
caucugaugccacaacugc

SEQ ID NO: 7810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucugaugccacaacugctt

SEQ ID NO: 7811 - RNA, 19 nt, Artificial Sequence
  source: /note="Description of Artificial Sequence: Synthetic oligonucleotide"
gcaguuguggcaucagaug

SEQ ID NO: 7812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaguuguggcaucagaugtt

SEQ ID NO: 7813 - RNA, 19 nt, Artificial Sequence
  source: /note="Description of Artificial Sequence: Synthetic oligonucleotide"
aucugaugccacaacugcu

SEQ ID NO: 7814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugaugccacaacugcutt

SEQ ID NO: 7815 - RNA, 19 nt, Artificial Sequence
  source: /note="Description of Artificial Sequence: Synthetic oligonucleotide"
agcaguuguggcaucagau

SEQ ID NO: 7816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaguuguggcaucagautt

SEQ ID NO: 7817 - RNA, 19 nt, Artificial Sequence
  source: /note="Description of Artificial Sequence: Synthetic oligonucleotide"
augccacaacugcuacccu

SEQ ID NO: 7818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augccacaacugcuacccutt

SEQ ID NO: 7819 - RNA, 19 nt, Artificial Sequence
  source: /note="Description of Artificial Sequence: Synthetic oligonucleotide"
aggguagcaguuguggcau

SEQ ID NO: 7820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggguagcaguuguggcautt

SEQ ID NO: 7821 - RNA, 19 nt, Artificial Sequence
  source: /note="Description of Artificial Sequence: Synthetic oligonucleotide"
ugccacaacugcuacccuc

SEQ ID NO: 7822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccacaacugcuacccuctt

SEQ ID NO: 7823 - RNA, 19 nt, Artificial Sequence
  source: /note="Description of Artificial Sequence: Synthetic oligonucleotide"
gaggguagcaguuguggca

SEQ ID NO: 7824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggguagcaguuguggcatt

SEQ ID NO: 7825 - RNA, 19 nt, Artificial Sequence
  source: /note="Description of Artificial Sequence: Synthetic oligonucleotide"
gccacaacugcuacccucg

SEQ ID NO: 7826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacaacugcuacccucgtt

SEQ ID NO: 7827 - RNA, 19 nt, Artificial Sequence
  source: /note="Description of Artificial Sequence: Synthetic oligonucleotide"
cgaggguagcaguuguggc

SEQ ID NO: 7828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaggguagcaguuguggctt

SEQ ID NO: 7829 - RNA, 19 nt, Artificial Sequence
  source: /note="Description of Artificial Sequence: Synthetic oligonucleotide"
ccacaacugcuacccucgc

SEQ ID NO: 7830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaacugcuacccucgctt

SEQ ID NO: 7831 - RNA, 19 nt, Artificial Sequence
  source: /note="Description of Artificial Sequence: Synthetic oligonucleotide"
gcgaggguagcaguugugg

SEQ ID NO: 7832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgaggguagcaguuguggtt

SEQ ID NO: 7833 - RNA, 19 nt, Artificial Sequence
  source: /note="Description of Artificial Sequence: Synthetic oligonucleotide"
ccccaccgacuaccccucc

SEQ ID NO: 7834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccaccgacuaccccucctt

SEQ ID NO: 7835 - RNA, 19 nt, Artificial Sequence
  source: /note="Description of Artificial Sequence: Synthetic oligonucleotide"
ggagggguagucggugggg

SEQ ID NO: 7836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagggguagucgguggggtt

SEQ ID NO: 7837 - RNA, 19 nt, Artificial Sequence
  source: /note="Description of Artificial Sequence: Synthetic oligonucleotide"
uaccccuccacguccaucu

SEQ ID NO: 7838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccccuccacguccaucutt

SEQ ID NO: 7839 - RNA, 19 nt, Artificial Sequence
  source: /note="Description of Artificial Sequence: Synthetic oligonucleotide"
agauggacguggaggggua

SEQ ID NO: 7840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauggacguggagggguatt

SEQ ID NO: 7841 - RNA, 19 nt, Artificial Sequence
  source: /note="Description of Artificial Sequence: Synthetic oligonucleotide"
cccuccacguccaucuggg

SEQ ID NO: 7842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuccacguccaucugggtt

SEQ ID NO: 7843 - RNA, 19 nt, Artificial Sequence
  source: /note="Description of Artificial Sequence: Synthetic oligonucleotide"
cccagauggacguggaggg

SEQ ID NO: 7844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagauggacguggagggtt

SEQ ID NO: 7845 - RNA, 19 nt, Artificial Sequence
  source: /note="Description of Artificial Sequence: Synthetic oligonucleotide"
cuccacguccaucugggaa

SEQ ID NO: 7846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccacguccaucugggaatt

SEQ ID NO: 7847 - RNA, 19 nt, Artificial Sequence
  source: /note="Description of Artificial Sequence: Synthetic oligonucleotide"
uucccagauggacguggag

SEQ ID NO: 7848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccagauggacguggagtt

SEQ ID NO: 7849 - RNA, 19 nt, Artificial Sequence
  source: /note="Description of Artificial Sequence: Synthetic oligonucleotide"
uccaucugggaaggcccaa

SEQ ID NO: 7850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaucugggaaggcccaatt

SEQ ID NO: 7851 - RNA, 19 nt, Artificial Sequence
  source: /note="Description of Artificial Sequence: Synthetic oligonucleotide"
uugggccuucccagaugga

SEQ ID NO: 7852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggccuucccagauggatt

SEQ ID NO: 7853 - RNA, 19 nt, Artificial Sequence
  source: /note="Description of Artificial Sequence: Synthetic oligonucleotide"
ccaucugggaaggcccaag

SEQ ID NO: 7854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucugggaaggcccaagtt

SEQ ID NO: 7855 - RNA, 19 nt, Artificial Sequence
  source: /note="Description of Artificial Sequence: Synthetic oligonucleotide"
cuugggccuucccagaugg

SEQ ID NO: 7856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugggccuucccagauggtt

SEQ ID NO: 7857 - RNA, 19 nt, Artificial Sequence
  source: /note="Description of Artificial Sequence: Synthetic oligonucleotide"
caucugggaaggcccaagu

SEQ ID NO: 7858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucugggaaggcccaagutt

SEQ ID NO: 7859 - RNA, 19 nt, Artificial Sequence
  source: /note="Description of Artificial Sequence: Synthetic oligonucleotide"
acuugggccuucccagaug

SEQ ID NO: 7860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugggccuucccagaugtt

SEQ ID NO: 7861 - RNA, 19 nt, Artificial Sequence
  source: /note="Description of Artificial Sequence: Synthetic oligonucleotide"
aucugggaaggcccaagug

SEQ ID NO: 7862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugggaaggcccaagugtt

SEQ ID NO: 7863 - RNA, 19 nt, Artificial Sequence
  source: /note="Description of Artificial Sequence: Synthetic oligonucleotide"
cacuugggccuucccagau

SEQ ID NO: 7864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuugggccuucccagautt

SEQ ID NO: 7865 - RNA, 19 nt, Artificial Sequence
  source: /note="Description of Artificial Sequence: Synthetic oligonucleotide"
ugggaaggcccaaguggcg

SEQ ID NO: 7866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggaaggcccaaguggcgtt

SEQ ID NO: 7867 - RNA, 19 nt, Artificial Sequence
  source: /note="Description of Artificial Sequence: Synthetic oligonucleotide"
cgccacuugggccuuccca

SEQ ID NO: 7868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccacuugggccuucccatt

SEQ ID NO: 7869 - RNA, 19 nt, Artificial Sequence
  source: /note="Description of Artificial Sequence: Synthetic oligonucleotide"
gggaaggcccaaguggcgc

SEQ ID NO: 7870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaaggcccaaguggcgctt

SEQ ID NO: 7871 - RNA, 19 nt, Artificial Sequence
  source: /note="Description of Artificial Sequence: Synthetic oligonucleotide"
gcgccacuugggccuuccc

SEQ ID NO: 7872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgccacuugggccuuccctt

SEQ ID NO: 7873 - RNA, 19 nt, Artificial Sequence
  source: /note="Description of Artificial Sequence: Synthetic oligonucleotide"
ggaaggcccaaguggcgcu

SEQ ID NO: 7874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaggcccaaguggcgcutt

SEQ ID NO: 7875 - RNA, 19 nt, Artificial Sequence
  source: /note="Description of Artificial Sequence: Synthetic oligonucleotide"
agcgccacuugggccuucc

SEQ ID NO: 7876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgccacuugggccuucctt

SEQ ID NO: 7877 - RNA, 19 nt, Artificial Sequence
  source: /note="Description of Artificial Sequence: Synthetic oligonucleotide"
gaaggcccaaguggcgcug

SEQ ID NO: 7878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggcccaaguggcgcugtt

SEQ ID NO: 7879 - RNA, 19 nt, Artificial Sequence
  source: /note="Description of Artificial Sequence: Synthetic oligonucleotide"
cagcgccacuugggccuuc

SEQ ID NO: 7880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcgccacuugggccuuctt

SEQ ID NO: 7881 - RNA, 19 nt, Artificial Sequence
  source: /note="Description of Artificial Sequence: Synthetic oligonucleotide"
aaggcccaaguggcgcugg

SEQ ID NO: 7882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcccaaguggcgcuggtt

SEQ ID NO: 7883 - RNA, 19 nt, Artificial Sequence
  source: /note="Description of Artificial Sequence: Synthetic oligonucleotide"
ccagcgccacuugggccuu

SEQ ID NO: 7884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcgccacuugggccuutt

SEQ ID NO: 7885 - RNA, 19 nt, Artificial Sequence
  source: /note="Description of Artificial Sequence: Synthetic oligonucleotide"
aggcccaaguggcgcuggg

SEQ ID NO: 7886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcccaaguggcgcugggtt

SEQ ID NO: 7887 - RNA, 19 nt, Artificial Sequence
  source: /note="Description of Artificial Sequence: Synthetic oligonucleotide"
cccagcgccacuugggccu

SEQ ID NO: 7888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcgccacuugggccutt

SEQ ID NO: 7889 - RNA, 19 nt, Artificial Sequence
  source: /note="Description of Artificial Sequence: Synthetic oligonucleotide"
ggcccaaguggcgcuggga

SEQ ID NO: 7890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccaaguggcgcugggatt

SEQ ID NO: 7891 - RNA, 19 nt, Artificial Sequence
  source: /note="Description of Artificial Sequence: Synthetic oligonucleotide"
ucccagcgccacuugggcc

SEQ ID NO: 7892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccagcgccacuugggcctt

SEQ ID NO: 7893 - RNA, 19 nt, Artificial Sequence
  source: /note="Description of Artificial Sequence: Synthetic oligonucleotide"
aaguggcgcugggaagggg

SEQ ID NO: 7894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguggcgcugggaaggggtt

SEQ ID NO: 7895 - RNA, 19 nt, Artificial Sequence
  source: /note="Description of Artificial Sequence: Synthetic oligonucleotide"
ccccuucccagcgccacuu

SEQ ID NO: 7896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuucccagcgccacuutt

SEQ ID NO: 7897 - RNA, 19 nt, Artificial Sequence
  source: /note="Description of Artificial Sequence: Synthetic oligonucleotide"
aguggcgcugggaaggggg

SEQ ID NO: 7898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcgcugggaagggggtt

SEQ ID NO: 7899 - RNA, 19 nt, Artificial Sequence
  source: /note="Description of Artificial Sequence: Synthetic oligonucleotide"
cccccuucccagcgccacu

SEQ ID NO: 7900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccuucccagcgccacutt

SEQ ID NO: 7901 - RNA, 19 nt, Artificial Sequence
  source: /note="Description of Artificial Sequence: Synthetic oligonucleotide"
gcgcugggaagggggccac

SEQ ID NO: 7902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgcugggaagggggccactt

SEQ ID NO: 7903 - RNA, 19 nt, Artificial Sequence
  source: /note="Description of Artificial Sequence: Synthetic oligonucleotide"
guggcccccuucccagcgc

SEQ ID NO: 7904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcccccuucccagcgctt

SEQ ID NO: 7905 - RNA, 19 nt, Artificial Sequence
  source: /note="Description of Artificial Sequence: Synthetic oligonucleotide"
cgcugggaagggggccaca

SEQ ID NO: 7906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugggaagggggccacatt

SEQ ID NO: 7907 - RNA, 19 nt, Artificial Sequence
  source: /note="Description of Artificial Sequence: Synthetic oligonucleotide"
uguggcccccuucccagcg

SEQ ID NO: 7908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggcccccuucccagcgtt

SEQ ID NO: 7909 - RNA, 19 nt, Artificial Sequence
  source: /note="Description of Artificial Sequence: Synthetic oligonucleotide"
cugggaagggggccacagc

SEQ ID NO: 7910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggaagggggccacagctt

SEQ ID NO: 7911 - RNA, 19 nt, Artificial Sequence
  source: /note="Description of Artificial Sequence: Synthetic oligonucleotide"
gcuguggcccccuucccag

SEQ ID NO: 7912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguggcccccuucccagtt

SEQ ID NO: 7913 - RNA, 19 nt, Artificial Sequence
  source: /note="Description of Artificial Sequence: Synthetic oligonucleotide"
ugggaagggggccacagcc

SEQ ID NO: 7914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggaagggggccacagcctt

SEQ ID NO: 7915 - RNA, 19 nt, Artificial Sequence
  source: /note="Description of Artificial Sequence: Synthetic oligonucleotide"
ggcuguggcccccuuccca

SEQ ID NO: 7916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuguggcccccuucccatt

SEQ ID NO: 7917 - RNA, 19 nt, Artificial Sequence
  source: /note="Description of Artificial Sequence: Synthetic oligonucleotide"
gggaagggggccacagccc

SEQ ID NO: 7918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaagggggccacagccctt

SEQ ID NO: 7919 - RNA, 19 nt, Artificial Sequence
  source: /note="Description of Artificial Sequence: Synthetic oligonucleotide"
gggcuguggcccccuuccc

SEQ ID NO: 7920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuguggcccccuuccctt

SEQ ID NO: 7921 - RNA, 19 nt, Artificial Sequence
  source: /note="Description of Artificial Sequence: Synthetic oligonucleotide"
ggaagggggccacagccca

SEQ ID NO: 7922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagggggccacagcccatt

SEQ ID NO: 7923 - RNA, 19 nt, Artificial Sequence
  source: /note="Description of Artificial Sequence: Synthetic oligonucleotide"
ugggcuguggcccccuucc

SEQ ID NO: 7924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuguggcccccuucctt

SEQ ID NO: 7925 - RNA, 19 nt, Artificial Sequence
  source: /note="Description of Artificial Sequence: Synthetic oligonucleotide"
gaagggggccacagcccau

SEQ ID NO: 7926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagggggccacagcccautt

SEQ ID NO: 7927 - RNA, 19 nt, Artificial Sequence
  source: /note="Description of Artificial Sequence: Synthetic oligonucleotide"
augggcuguggcccccuuc

SEQ ID NO: 7928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augggcuguggcccccuuctt

SEQ ID NO: 7929 - RNA, 19 nt, Artificial Sequence
  source: /note="Description of Artificial Sequence: Synthetic oligonucleotide"
aagggggccacagcccauc

SEQ ID NO: 7930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggggccacagcccauctt

SEQ ID NO: 7931 - RNA, 19 nt, Artificial Sequence
  source: /note="Description of Artificial Sequence: Synthetic oligonucleotide"
gaugggcuguggcccccuu

SEQ ID NO: 7932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugggcuguggcccccuutt

SEQ ID NO: 7933 - RNA, 19 nt, Artificial Sequence
  source: /note="Description of Artificial Sequence: Synthetic oligonucleotide"
agggggccacagcccauca

SEQ ID NO: 7934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggggccacagcccaucatt

SEQ ID NO: 7935 - RNA, 19 nt, Artificial Sequence
  source: /note="Description of Artificial Sequence: Synthetic oligonucleotide"
ugaugggcuguggcccccu

SEQ ID NO: 7936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaugggcuguggcccccutt

SEQ ID NO: 7937 - RNA, 19 nt, Artificial Sequence
  source: /note="Description of Artificial Sequence: Synthetic oligonucleotide"
gggccacagcccaucaagc

SEQ ID NO: 7938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccacagcccaucaagctt

SEQ ID NO: 7939 - RNA, 19 nt, Artificial Sequence
  source: /note="Description of Artificial Sequence: Synthetic oligonucleotide"
gcuugaugggcuguggccc

SEQ ID NO: 7940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugaugggcuguggccctt

SEQ ID NO: 7941 - RNA, 19 nt, Artificial Sequence
  source: /note="Description of Artificial Sequence: Synthetic oligonucleotide"
ggccacagcccaucaagcu

SEQ ID NO: 7942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccacagcccaucaagcutt

SEQ ID NO: 7943 - RNA, 19 nt, Artificial Sequence
  source: /note="Description of Artificial Sequence: Synthetic oligonucleotide"
agcuugaugggcuguggcc

SEQ ID NO: 7944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuugaugggcuguggcctt

SEQ ID NO: 7945 - RNA, 19 nt, Artificial Sequence
  source: /note="Description of Artificial Sequence: Synthetic oligonucleotide"
ccacagcccaucaagcucc

SEQ ID NO: 7946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagcccaucaagcucctt

SEQ ID NO: 7947 - RNA, 19 nt, Artificial Sequence
  source: /note="Description of Artificial Sequence: Synthetic oligonucleotide"
ggagcuugaugggcugugg

SEQ ID NO: 7948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcuugaugggcuguggtt

SEQ ID NO: 7949 - RNA, 19 nt, Artificial Sequence
  source: /note="Description of Artificial Sequence: Synthetic oligonucleotide"
cacagcccaucaagcuccu

SEQ ID NO: 7950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagcccaucaagcuccutt

SEQ ID NO: 7951 - RNA, 19 nt, Artificial Sequence
  source: /note="Description of Artificial Sequence: Synthetic oligonucleotide"
aggagcuugaugggcugug

SEQ ID NO: 7952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggagcuugaugggcugugtt

SEQ ID NO: 7953 - RNA, 19 nt, Artificial Sequence
  source: /note="Description of Artificial Sequence: Synthetic oligonucleotide"
acagcccaucaagcuccug

SEQ ID NO: 7954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcccaucaagcuccugtt

SEQ ID NO: 7955 - RNA, 19 nt, Artificial Sequence
  source: /note="Description of Artificial Sequence: Synthetic oligonucleotide"
caggagcuugaugggcugu

SEQ ID NO: 7956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggagcuugaugggcugutt

SEQ ID NO: 7957 - RNA, 19 nt, Artificial Sequence
  source: /note="Description of Artificial Sequence: Synthetic oligonucleotide"
cccaucaagcuccugcccu

SEQ ID NO: 7958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaucaagcuccugcccutt

SEQ ID NO: 7959 - RNA, 19 nt, Artificial Sequence
  source: /note="Description of Artificial Sequence: Synthetic oligonucleotide"
agggcaggagcuugauggg

SEQ ID NO: 7960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggcaggagcuugaugggtt

SEQ ID NO: 7961 - RNA, 19 nt, Artificial Sequence
  source: /note="Description of Artificial Sequence: Synthetic oligonucleotide"
ccaucaagcuccugcccug

SEQ ID NO: 7962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucaagcuccugcccugtt

SEQ ID NO: 7963 - RNA, 19 nt, Artificial Sequence
  source: /note="Description of Artificial Sequence: Synthetic oligonucleotide"
cagggcaggagcuugaugg

SEQ ID NO: 7964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggcaggagcuugauggtt

SEQ ID NO: 7965 - RNA, 19 nt, Artificial Sequence
  source: /note="Description of Artificial Sequence: Synthetic oligonucleotide"
caucaagcuccugcccugg

SEQ ID NO: 7966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagcuccugcccuggtt

SEQ ID NO: 7967 - RNA, 19 nt, Artificial Sequence
  source: /note="Description of Artificial Sequence: Synthetic oligonucleotide"
ccagggcaggagcuugaug

SEQ ID NO: 7968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggcaggagcuugaugtt

SEQ ID NO: 7969 - RNA, 19 nt, Artificial Sequence
  source: /note="Description of Artificial Sequence: Synthetic oligonucleotide"
aucaagcuccugcccuggc

SEQ ID NO: 7970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagcuccugcccuggctt

SEQ ID NO: 7971 - RNA, 19 nt, Artificial Sequence
  source: /note="Description of Artificial Sequence: Synthetic oligonucleotide"
gccagggcaggagcuugau

SEQ ID NO: 7972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagggcaggagcuugautt

SEQ ID NO: 7973 - RNA, 19 nt, Artificial Sequence
  source: /note="Description of Artificial Sequence: Synthetic oligonucleotide"
caagcuccugcccuggcug

SEQ ID NO: 7974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcuccugcccuggcugtt

SEQ ID NO: 7975 - RNA, 19 nt, Artificial Sequence
  source: /note="Description of Artificial Sequence: Synthetic oligonucleotide"
cagccagggcaggagcuug

SEQ ID NO: 7976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccagggcaggagcuugtt

SEQ ID NO: 7977 - RNA, 19 nt, Artificial Sequence
  source: /note="Description of Artificial Sequence: Synthetic oligonucleotide"
aagcuccugcccuggcugg

SEQ ID NO: 7978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuccugcccuggcuggtt

SEQ ID NO: 7979 - RNA, 19 nt, Artificial Sequence
  source: /note="Description of Artificial Sequence: Synthetic oligonucleotide"
ccagccagggcaggagcuu

SEQ ID NO: 7980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagccagggcaggagcuutt

SEQ ID NO: 7981 - RNA, 19 nt, Artificial Sequence
  source: /note="Description of Artificial Sequence: Synthetic oligonucleotide"
cuccugcccuggcugggcc

SEQ ID NO: 7982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccugcccuggcugggcctt

SEQ ID NO: 7983 - RNA, 19 nt, Artificial Sequence
  source: /note="Description of Artificial Sequence: Synthetic oligonucleotide"
ggcccagccagggcaggag

SEQ ID NO: 7984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccagccagggcaggagtt

SEQ ID NO: 7985 - RNA, 19 nt, Artificial Sequence
  source: /note="Description of Artificial Sequence: Synthetic oligonucleotide"
cugcccuggcugggccccu

SEQ ID NO: 7986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcccuggcugggccccutt

SEQ ID NO: 7987 - RNA, 19 nt, Artificial Sequence
  source: /note="Description of Artificial Sequence: Synthetic oligonucleotide"
aggggcccagccagggcag

SEQ ID NO: 7988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggcccagccagggcagtt

SEQ ID NO: 7989 - RNA, 19 nt, Artificial Sequence
  source: /note="Description of Artificial Sequence: Synthetic oligonucleotide"
gcccuggcugggccccuag

SEQ ID NO: 7990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccuggcugggccccuagtt

SEQ ID NO: 7991 - RNA, 19 nt, Artificial Sequence
  source: /note="Description of Artificial Sequence: Synthetic oligonucleotide"
cuaggggcccagccagggc

SEQ ID NO: 7992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggggcccagccagggctt

SEQ ID NO: 7993 - RNA, 19 nt, Artificial Sequence
  source: /note="Description of Artificial Sequence: Synthetic oligonucleotide"
ccuggcugggccccuagac

SEQ ID NO: 7994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggcugggccccuagactt

SEQ ID NO: 7995 - RNA, 19 nt, Artificial Sequence
  source: /note="Description of Artificial Sequence: Synthetic oligonucleotide"
gucuaggggcccagccagg

SEQ ID NO: 7996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuaggggcccagccaggtt

SEQ ID NO: 7997 - RNA, 19 nt, Artificial Sequence
  source: /note="Description of Artificial Sequence: Synthetic oligonucleotide"
cuggcugggccccuagacu

SEQ ID NO: 7998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcugggccccuagacutt

SEQ ID NO: 7999 - RNA, 19 nt, Artificial Sequence
  source: /note="Description of Artificial Sequence: Synthetic oligonucleotide"
agucuaggggcccagccag

SEQ ID NO: 8000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucuaggggcccagccagtt

SEQ ID NO: 8001 - RNA, 19 nt, Artificial Sequence
  source: /note="Description of Artificial Sequence: Synthetic oligonucleotide"
uggcugggccccuagacua

SEQ ID NO: 8002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcugggccccuagacuatt

SEQ ID NO: 8003 - RNA, 19 nt, Artificial Sequence
  source: /note="Description of Artificial Sequence: Synthetic oligonucleotide"
uagucuaggggcccagcca

SEQ ID NO: 8004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagucuaggggcccagccatt

SEQ ID NO: 8005 - RNA, 19 nt, Artificial Sequence
  source: /note="Description of Artificial Sequence: Synthetic oligonucleotide"
cugggccccuagacuagag

SEQ ID NO: 8006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggccccuagacuagagtt

SEQ ID NO: 8007 - RNA, 19 nt, Artificial Sequence
  source: /note="Description of Artificial Sequence: Synthetic oligonucleotide"
cucuagucuaggggcccag

SEQ ID NO: 8008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuagucuaggggcccagtt

SEQ ID NO: 8009 - RNA, 19 nt, Artificial Sequence
  source: /note="Description of Artificial Sequence: Synthetic oligonucleotide"
gggccccuagacuagaggg

SEQ ID NO: 8010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccccuagacuagagggtt

SEQ ID NO: 8011 - RNA, 19 nt, Artificial Sequence
  source: /note="Description of Artificial Sequence: Synthetic oligonucleotide"
cccucuagucuaggggccc

SEQ ID NO: 8012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucuagucuaggggccctt

SEQ ID NO: 8013 - RNA, 19 nt, Artificial Sequence
  source: /note="Description of Artificial Sequence: Synthetic oligonucleotide"
ggccccuagacuagagggc

SEQ ID NO: 8014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccuagacuagagggctt

SEQ ID NO: 8015 - RNA, 19 nt, Artificial Sequence
  source: /note="Description of Artificial Sequence: Synthetic oligonucleotide"
gcccucuagucuaggggcc

SEQ ID NO: 8016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccucuagucuaggggcctt

SEQ ID NO: 8017 - RNA, 19 nt, Artificial Sequence
  source: /note="Description of Artificial Sequence: Synthetic oligonucleotide"
cuagacuagagggcagagg

SEQ ID NO: 8018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagacuagagggcagaggtt

SEQ ID NO: 8019 - RNA, 19 nt, Artificial Sequence
  source: /note="Description of Artificial Sequence: Synthetic oligonucleotide"
ccucugcccucuagucuag

SEQ ID NO: 8020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucugcccucuagucuagtt

SEQ ID NO: 8021 - RNA, 19 nt, Artificial Sequence
  source: /note="Description of Artificial Sequence: Synthetic oligonucleotide"
acuagagggcagagguaaa

SEQ ID NO: 8022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuagagggcagagguaaatt

SEQ ID NO: 8023 - RNA, 19 nt, Artificial Sequence
  source: /note="Description of Artificial Sequence: Synthetic oligonucleotide"
uuuaccucugcccucuagu

SEQ ID NO: 8024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaccucugcccucuagutt

SEQ ID NO: 8025 - RNA, 19 nt, Artificial Sequence
  source: /note="Description of Artificial Sequence: Synthetic oligonucleotide"
uagagggcagagguaaaug

SEQ ID NO: 8026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagagggcagagguaaaugtt

SEQ ID NO: 8027 - RNA, 19 nt, Artificial Sequence
  source: /note="Description of Artificial Sequence: Synthetic oligonucleotide"
cauuuaccucugcccucua

SEQ ID NO: 8028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuuaccucugcccucuatt

SEQ ID NO: 8029 - RNA, 19 nt, Artificial Sequence
  source: /note="Description of Artificial Sequence: Synthetic oligonucleotide"
agggcagagguaaaugaac

SEQ ID NO: 8030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggcagagguaaaugaactt

SEQ ID NO: 8031 - RNA, 19 nt, Artificial Sequence
  source: /note="Description of Artificial Sequence: Synthetic oligonucleotide"
guucauuuaccucugcccu

SEQ ID NO: 8032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucauuuaccucugcccutt

SEQ ID NO: 8033 - RNA, 19 nt, Artificial Sequence
  source: /note="Description of Artificial Sequence: Synthetic oligonucleotide"
agagguaaaugaacuaccc

SEQ ID NO: 8034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagguaaaugaacuaccctt

SEQ ID NO: 8035 - RNA, 19 nt, Artificial Sequence
  source: /note="Description of Artificial Sequence: Synthetic oligonucleotide"
ggguaguucauuuaccucu

SEQ ID NO: 8036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguaguucauuuaccucutt

SEQ ID NO: 8037 - RNA, 19 nt, Artificial Sequence
  source: /note="Description of Artificial Sequence: Synthetic oligonucleotide"
aaugaacuacccccagcau

SEQ ID NO: 8038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugaacuacccccagcautt

SEQ ID NO: 8039 - RNA, 19 nt, Artificial Sequence
  source: /note="Description of Artificial Sequence: Synthetic oligonucleotide"
augcuggggguaguucauu

SEQ ID NO: 8040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augcuggggguaguucauutt

SEQ ID NO: 8041 - RNA, 19 nt, Artificial Sequence
  source: /note="Description of Artificial Sequence: Synthetic oligonucleotide"
acuacccccagcaucuagg

SEQ ID NO: 8042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuacccccagcaucuaggtt

SEQ ID NO: 8043 - RNA, 19 nt, Artificial Sequence
  source: /note="Description of Artificial Sequence: Synthetic oligonucleotide"
ccuagaugcuggggguagu

SEQ ID NO: 8044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuagaugcuggggguagutt

SEQ ID NO: 8045 - RNA, 19 nt, Artificial Sequence
  source: /note="Description of Artificial Sequence: Synthetic oligonucleotide"
cuacccccagcaucuaggc

SEQ ID NO: 8046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacccccagcaucuaggctt

SEQ ID NO: 8047 - RNA, 19 nt, Artificial Sequence
  source: /note="Description of Artificial Sequence: Synthetic oligonucleotide"
gccuagaugcuggggguag

SEQ ID NO: 8048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuagaugcuggggguagtt

SEQ ID NO: 8049 - RNA, 19 nt, Artificial Sequence
  source: /note="Description of Artificial Sequence: Synthetic oligonucleotide"
acccccagcaucuaggccu

SEQ ID NO: 8050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccccagcaucuaggccutt

SEQ ID NO: 8051 - RNA, 19 nt, Artificial Sequence
  source: /note="Description of Artificial Sequence: Synthetic oligonucleotide"
aggccuagaugcugggggu

SEQ ID NO: 8052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccuagaugcugggggutt

SEQ ID NO: 8053 - RNA, 19 nt, Artificial Sequence
  source: /note="Description of Artificial Sequence: Synthetic oligonucleotide"
ccccagcaucuaggccucc

SEQ ID NO: 8054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagcaucuaggccucctt

SEQ ID NO: 8055 - RNA, 19 nt, Artificial Sequence
  source: /note="Description of Artificial Sequence: Synthetic oligonucleotide"
ggaggccuagaugcugggg

SEQ ID NO: 8056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggccuagaugcuggggtt

SEQ ID NO: 8057 - RNA, 19 nt, Artificial Sequence
  source: /note="Description of Artificial Sequence: Synthetic oligonucleotide"
agcaucuaggccucccuca

SEQ ID NO: 8058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaucuaggccucccucatt

SEQ ID NO: 8059 - RNA, 19 nt, Artificial Sequence
  source: /note="Description of Artificial Sequence: Synthetic oligonucleotide"
ugagggaggccuagaugcu

SEQ ID NO: 8060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagggaggccuagaugcutt

SEQ ID NO: 8061 - RNA, 19 nt, Artificial Sequence
  source: /note="Description of Artificial Sequence: Synthetic oligonucleotide"
uaaccucuguggugggcuu

SEQ ID NO: 8062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaccucuguggugggcuutt

SEQ ID NO: 8063 - RNA, 19 nt, Artificial Sequence
  source: /note="Description of Artificial Sequence: Synthetic oligonucleotide"
aagcccaccacagagguua

SEQ ID NO: 8064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcccaccacagagguuatt

SEQ ID NO: 8065 - RNA, 19 nt, Artificial Sequence
  source: /note="Description of Artificial Sequence: Synthetic oligonucleotide"
aaccucuguggugggcuuu

SEQ ID NO: 8066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccucuguggugggcuuutt

SEQ ID NO: 8067 - RNA, 19 nt, Artificial Sequence
  source: /note="Description of Artificial Sequence: Synthetic oligonucleotide"
aaagcccaccacagagguu

SEQ ID NO: 8068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcccaccacagagguutt

SEQ ID NO: 8069 - RNA, 19 nt, Artificial Sequence
  source: /note="Description of Artificial Sequence: Synthetic oligonucleotide"
cucuguggugggcuuuuua

SEQ ID NO: 8070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuguggugggcuuuuuatt

SEQ ID NO: 8071 - RNA, 19 nt, Artificial Sequence
  source: /note="Description of Artificial Sequence: Synthetic oligonucleotide"
uaaaaagcccaccacagag

SEQ ID NO: 8072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaaagcccaccacagagtt

SEQ ID NO: 8073 - RNA, 19 nt, Artificial Sequence
  source: /note="Description of Artificial Sequence: Synthetic oligonucleotide"
ucuguggugggcuuuuuaa

SEQ ID NO: 8074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguggugggcuuuuuaatt

SEQ ID NO: 8075 - RNA, 19 nt, Artificial Sequence
  source: /note="Description of Artificial Sequence: Synthetic oligonucleotide"
uuaaaaagcccaccacaga

SEQ ID NO: 8076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaaagcccaccacagatt

SEQ ID NO: 8077 - RNA, 19 nt, Artificial Sequence
  source: /note="Description of Artificial Sequence: Synthetic oligonucleotide"
cuguggugggcuuuuuaaa

SEQ ID NO: 8078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggugggcuuuuuaaatt

SEQ ID NO: 8079 - RNA, 19 nt, Artificial Sequence
  source: /note="Description of Artificial Sequence: Synthetic oligonucleotide"
uuuaaaaagcccaccacag

SEQ ID NO: 8080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaaaaagcccaccacagtt

SEQ ID NO: 8081 - RNA, 19 nt, Artificial Sequence
  source: /note="Description of Artificial Sequence: Synthetic oligonucleotide"
uguggugggcuuuuuaaag

SEQ ID NO: 8082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggugggcuuuuuaaagtt

SEQ ID NO: 8083 - RNA, 19 nt, Artificial Sequence
  source: /note="Description of Artificial Sequence: Synthetic oligonucleotide"
cuuuaaaaagcccaccaca

SEQ ID NO: 8084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuaaaaagcccaccacatt

SEQ ID NO: 8085 - RNA, 19 nt, Artificial Sequence
  source: /note="Description of Artificial Sequence: Synthetic oligonucleotide"
guggugggcuuuuuaaaga

SEQ ID NO: 8086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggugggcuuuuuaaagatt

SEQ ID NO: 8087 - RNA, 19 nt, Artificial Sequence
  source: /note="Description of Artificial Sequence: Synthetic oligonucleotide"
ucuuuaaaaagcccaccac

SEQ ID NO: 8088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuuaaaaagcccaccactt

SEQ ID NO: 8089 - RNA, 19 nt, Artificial Sequence
  source: /note="Description of Artificial Sequence: Synthetic oligonucleotide"
ggugggcuuuuuaaagagg

SEQ ID NO: 8090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugggcuuuuuaaagaggtt

SEQ ID NO: 8091 - RNA, 19 nt, Artificial Sequence
  source: /note="Description of Artificial Sequence: Synthetic oligonucleotide"
ccucuuuaaaaagcccacc

SEQ ID NO: 8092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuuuaaaaagcccacctt

SEQ ID NO: 8093 - RNA, 19 nt, Artificial Sequence
  source: /note="Description of Artificial Sequence: Synthetic oligonucleotide"
gggcuuuuuaaagaggauu

SEQ ID NO: 8094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuuuuuaaagaggauutt

SEQ ID NO: 8095 - RNA, 19 nt, Artificial Sequence
  source: /note="Description of Artificial Sequence: Synthetic oligonucleotide"
aauccucuuuaaaaagccc

SEQ ID NO: 8096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauccucuuuaaaaagccctt

SEQ ID NO: 8097 - RNA, 19 nt, Artificial Sequence
  source: /note="Description of Artificial Sequence: Synthetic oligonucleotide"
ggcuuuuuaaagaggauuu

SEQ ID NO: 8098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuuuuuaaagaggauuutt

SEQ ID NO: 8099 - RNA, 19 nt, Artificial Sequence
  source: /note="Description of Artificial Sequence: Synthetic oligonucleotide"
aaauccucuuuaaaaagcc

SEQ ID NO: 8100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauccucuuuaaaaagcctt

SEQ ID NO: 8101 - RNA, 19 nt, Artificial Sequence
  source: /note="Description of Artificial Sequence: Synthetic oligonucleotide"
aaggacgggguuugggggu

SEQ ID NO: 8102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggacgggguuugggggutt

SEQ ID NO: 8103 - RNA, 19 nt, Artificial Sequence
  source: /note="Description of Artificial Sequence: Synthetic oligonucleotide"
acccccaaaccccguccuu

SEQ ID NO: 8104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccccaaaccccguccuutt

SEQ ID NO: 8105 - RNA, 19 nt, Artificial Sequence
  source: /note="Description of Artificial Sequence: Synthetic oligonucleotide"
ggacgggguuugggggugu

SEQ ID NO: 8106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacgggguuugggggugutt

SEQ ID NO: 8107 - RNA, 19 nt, Artificial Sequence
  source: /note="Description of Artificial Sequence: Synthetic oligonucleotide"
acacccccaaaccccgucc

SEQ ID NO: 8108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacccccaaaccccgucctt

SEQ ID NO: 8109 - RNA, 19 nt, Artificial Sequence
  source: /note="Description of Artificial Sequence: Synthetic oligonucleotide"
cgggguuugggggugugag

SEQ ID NO: 8110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggguuugggggugugagtt

SEQ ID NO: 8111 - RNA, 19 nt, Artificial Sequence
  source: /note="Description of Artificial Sequence: Synthetic oligonucleotide"
cucacacccccaaaccccg

SEQ ID NO: 8112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucacacccccaaaccccgtt

SEQ ID NO: 8113 - RNA, 19 nt, Artificial Sequence
  source: /note="Description of Artificial Sequence: Synthetic oligonucleotide"
gggguuugggggugugagg

SEQ ID NO: 8114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggguuugggggugugaggtt

SEQ ID NO: 8115 - RNA, 19 nt, Artificial Sequence
  source: /note="Description of Artificial Sequence: Synthetic oligonucleotide"
ccucacacccccaaacccc

SEQ ID NO: 8116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucacacccccaaacccctt

SEQ ID NO: 8117 - RNA, 19 nt, Artificial Sequence
  source: /note="Description of Artificial Sequence: Synthetic oligonucleotide"
ggguuugggggugugagga

SEQ ID NO: 8118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguuugggggugugaggatt

SEQ ID NO: 8119 - RNA, 19 nt, Artificial Sequence
  source: /note="Description of Artificial Sequence: Synthetic oligonucleotide"
uccucacacccccaaaccc

SEQ ID NO: 8120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucacacccccaaaccctt

SEQ ID NO: 8121 - RNA, 19 nt, Artificial Sequence
  source: /note="Description of Artificial Sequence: Synthetic oligonucleotide"
gguuugggggugugaggac

SEQ ID NO: 8122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuugggggugugaggactt

SEQ ID NO: 8123 - RNA, 19 nt, Artificial Sequence
  source: /note="Description of Artificial Sequence: Synthetic oligonucleotide"
guccucacacccccaaacc

SEQ ID NO: 8124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccucacacccccaaacctt

SEQ ID NO: 8125 - RNA, 19 nt, Artificial Sequence
  source: /note="Description of Artificial Sequence: Synthetic oligonucleotide"
guuugggggugugaggacc

SEQ ID NO: 8126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuugggggugugaggacctt

SEQ ID NO: 8127 - RNA, 19 nt, Artificial Sequence
  source: /note="Description of Artificial Sequence: Synthetic oligonucleotide"
gguccucacacccccaaac

SEQ ID NO: 8128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccucacacccccaaactt

SEQ ID NO: 8129 - RNA, 19 nt, Artificial Sequence
  source: /note="Description of Artificial Sequence: Synthetic oligonucleotide"
uuugggggugugaggaccu

SEQ ID NO: 8130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugggggugugaggaccutt

SEQ ID NO: 8131 - RNA, 19 nt, Artificial Sequence
  source: /note="Description of Artificial Sequence: Synthetic oligonucleotide"
agguccucacacccccaaa

SEQ ID NO: 8132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguccucacacccccaaatt

SEQ ID NO: 8133 - RNA, 19 nt, Artificial Sequence
  source: /note="Description of Artificial Sequence: Synthetic oligonucleotide"
uugggggugugaggaccuu

SEQ ID NO: 8134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggggugugaggaccuutt

SEQ ID NO: 8135 - RNA, 19 nt, Artificial Sequence
  source: /note="Description of Artificial Sequence: Synthetic oligonucleotide"
aagguccucacacccccaa

SEQ ID NO: 8136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguccucacacccccaatt

SEQ ID NO: 8137 - RNA, 19 nt, Artificial Sequence
  source: /note="Description of Artificial Sequence: Synthetic oligonucleotide"
cuacccccuugguccccuc

SEQ ID NO: 8138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacccccuugguccccuctt

SEQ ID NO: 8139 - RNA, 19 nt, Artificial Sequence
  source: /note="Description of Artificial Sequence: Synthetic oligonucleotide"
gaggggaccaaggggguag

SEQ ID NO: 8140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggggaccaaggggguagtt

SEQ ID NO: 8141 - RNA, 19 nt, Artificial Sequence
  source: /note="Description of Artificial Sequence: Synthetic oligonucleotide"
uacccccuugguccccucc

SEQ ID NO: 8142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacccccuugguccccucctt

SEQ ID NO: 8143 - RNA, 19 nt, Artificial Sequence
  source: /note="Description of Artificial Sequence: Synthetic oligonucleotide"
ggaggggaccaagggggua

SEQ ID NO: 8144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggggaccaaggggguatt

SEQ ID NO: 8145 - RNA, 19 nt, Artificial Sequence
  source: /note="Description of Artificial Sequence: Synthetic oligonucleotide"
acccccuugguccccuccc

SEQ ID NO: 8146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccccuugguccccuccctt

SEQ ID NO: 8147 - RNA, 19 nt, Artificial Sequence
  source: /note="Description of Artificial Sequence: Synthetic oligonucleotide"
gggaggggaccaagggggu

SEQ ID NO: 8148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggggaccaagggggutt

SEQ ID NO: 8149 - RNA, 19 nt, Artificial Sequence
  source: /note="Description of Artificial Sequence: Synthetic oligonucleotide"
cccccuugguccccucccc

SEQ ID NO: 8150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccuugguccccucccctt

SEQ ID NO: 8151 - RNA, 19 nt, Artificial Sequence
  source: /note="Description of Artificial Sequence: Synthetic oligonucleotide"
ggggaggggaccaaggggg

SEQ ID NO: 8152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaggggaccaagggggtt

SEQ ID NO: 8153 - RNA, 19 nt, Artificial Sequence
  source: /note="Description of Artificial Sequence: Synthetic oligonucleotide"
ccccuugguccccuccccu

SEQ ID NO: 8154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuugguccccuccccutt

SEQ ID NO: 8155 - RNA, 19 nt, Artificial Sequence
  source: /note="Description of Artificial Sequence: Synthetic oligonucleotide"
aggggaggggaccaagggg

SEQ ID NO: 8156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggaggggaccaaggggtt

SEQ ID NO: 8157 - RNA, 19 nt, Artificial Sequence
  source: /note="Description of Artificial Sequence: Synthetic oligonucleotide"
cccuugguccccuccccuc

SEQ ID NO: 8158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuugguccccuccccuctt

SEQ ID NO: 8159 - RNA, 19 nt, Artificial Sequence
  source: /note="Description of Artificial Sequence: Synthetic oligonucleotide"
gaggggaggggaccaaggg

SEQ ID NO: 8160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggggaggggaccaagggtt

SEQ ID NO: 8161 - RNA, 19 nt, Artificial Sequence
  source: /note="Description of Artificial Sequence: Synthetic oligonucleotide"
ccuugguccccuccccucc

SEQ ID NO: 8162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugguccccuccccucctt

SEQ ID NO: 8163 - RNA, 19 nt, Artificial Sequence
  source: /note="Description of Artificial Sequence: Synthetic oligonucleotide"
ggaggggaggggaccaagg

SEQ ID NO: 8164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggggaggggaccaaggtt

SEQ ID NO: 8165 - RNA, 19 nt, Artificial Sequence
  source: /note="Description of Artificial Sequence: Synthetic oligonucleotide"
cuugguccccuccccuccc

SEQ ID NO: 8166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugguccccuccccuccctt

SEQ ID NO: 8167 - RNA, 19 nt, Artificial Sequence
  source: /note="Description of Artificial Sequence: Synthetic oligonucleotide"
gggaggggaggggaccaag

SEQ ID NO: 8168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggggaggggaccaagtt

SEQ ID NO: 8169 - RNA, 19 nt, Artificial Sequence
  source: /note="Description of Artificial Sequence: Synthetic oligonucleotide"
uugguccccuccccucccc

SEQ ID NO: 8170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguccccuccccucccctt

SEQ ID NO: 8171 - RNA, 19 nt, Artificial Sequence
  source: /note="Description of Artificial Sequence: Synthetic oligonucleotide"
ggggaggggaggggaccaa

SEQ ID NO: 8172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaggggaggggaccaatt

SEQ ID NO: 8173 - RNA, 19 nt, Artificial Sequence
  source: /note="Description of Artificial Sequence: Synthetic oligonucleotide"
uucuuguccucugcuccca

SEQ ID NO: 8174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuuguccucugcucccatt

SEQ ID NO: 8175 - RNA, 19 nt, Artificial Sequence
  source: /note="Description of Artificial Sequence: Synthetic oligonucleotide"
ugggagcagaggacaagaa

SEQ ID NO: 8176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggagcagaggacaagaatt

SEQ ID NO: 8177 - RNA, 19 nt, Artificial Sequence
  source: /note="Description of Artificial Sequence: Synthetic oligonucleotide"
ggaggcggcccugggggcu

SEQ ID NO: 8178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcggcccugggggcutt

SEQ ID NO: 8179 - RNA, 19 nt, Artificial Sequence
  source: /note="Description of Artificial Sequence: Synthetic oligonucleotide"
agcccccagggccgccucc

SEQ ID NO: 8180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccccagggccgccucctt

SEQ ID NO: 8181 - RNA, 19 nt, Artificial Sequence
  source: /note="Description of Artificial Sequence: Synthetic oligonucleotide"
ugggugggggcgugggagc

SEQ ID NO: 8182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggugggggcgugggagctt

SEQ ID NO: 8183 - RNA, 19 nt, Artificial Sequence
  source: /note="Description of Artificial Sequence: Synthetic oligonucleotide"
gcucccacgcccccaccca

SEQ ID NO: 8184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucccacgcccccacccatt

SEQ ID NO: 8185 - RNA, 19 nt, Artificial Sequence
  source: /note="Description of Artificial Sequence: Synthetic oligonucleotide"
cguucccaagaaguggcuu

SEQ ID NO: 8186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguucccaagaaguggcuutt

SEQ ID NO: 8187 - RNA, 19 nt, Artificial Sequence
  source: /note="Description of Artificial Sequence: Synthetic oligonucleotide"
aagccacuucuugggaacg

SEQ ID NO: 8188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccacuucuugggaacgtt

SEQ ID NO: 8189 - RNA, 19 nt, Artificial Sequence
  source: /note="Description of Artificial Sequence: Synthetic oligonucleotide"
aagugauugguaauggcuc

SEQ ID NO: 8190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagugauugguaauggcuctt

SEQ ID NO: 8191 - RNA, 19 nt, Artificial Sequence
  source: /note="Description of Artificial Sequence: Synthetic oligonucleotide"
gagccauuaccaaucacuu

SEQ ID NO: 8192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccauuaccaaucacuutt

SEQ ID NO: 8193 - RNA, 19 nt, Artificial Sequence
  source: /note="Description of Artificial Sequence: Synthetic oligonucleotide"
gguggccaucaagaagguu

SEQ ID NO: 8194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggccaucaagaagguutt

SEQ ID NO: 8195 - RNA, 19 nt, Artificial Sequence
  source: /note="Description of Artificial Sequence: Synthetic oligonucleotide"
aaccuucuugauggccacc

SEQ ID NO: 8196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccuucuugauggccacctt

SEQ ID NO: 8197 - RNA, 19 nt, Artificial Sequence
  source: /note="Description of Artificial Sequence: Synthetic oligonucleotide"
aucaagaagguucuucagg

SEQ ID NO: 8198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagaagguucuucaggtt

SEQ ID NO: 8199 - RNA, 19 nt, Artificial Sequence
  source: /note="Description of Artificial Sequence: Synthetic oligonucleotide"
ccugaagaaccuucuugau

SEQ ID NO: 8200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugaagaaccuucuugautt

SEQ ID NO: 8201 - RNA, 19 nt, Artificial Sequence
  source: /note="Description of Artificial Sequence: Synthetic oligonucleotide"
aagaagguucuucaggaca

SEQ ID NO: 8202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaagguucuucaggacatt

SEQ ID NO: 8203 - RNA, 19 nt, Artificial Sequence
  source: /note="Description of Artificial Sequence: Synthetic oligonucleotide"
uguccugaagaaccuucuu

SEQ ID NO: 8204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccugaagaaccuucuutt

SEQ ID NO: 8205 - RNA, 19 nt, Artificial Sequence
  source: /note="Description of Artificial Sequence: Synthetic oligonucleotide"
cgaguggcccgccacuuca

SEQ ID NO: 8206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaguggcccgccacuucatt

SEQ ID NO: 8207 - RNA, 19 nt, Artificial Sequence
  source: /note="Description of Artificial Sequence: Synthetic oligonucleotide"
ugaaguggcgggccacucg

SEQ ID NO: 8208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaguggcgggccacucgtt

SEQ ID NO: 8209 - RNA, 19 nt, Artificial Sequence
  source: /note="Description of Artificial Sequence: Synthetic oligonucleotide"
uguacauguaccagcucuu

SEQ ID NO: 8210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacauguaccagcucuutt

SEQ ID NO: 8211 - RNA, 19 nt, Artificial Sequence
  source: /note="Description of Artificial Sequence: Synthetic oligonucleotide"
aagagcugguacauguaca

SEQ ID NO: 8212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagagcugguacauguacatt

SEQ ID NO: 8213 - RNA, 19 nt, Artificial Sequence
  source: /note="Description of Artificial Sequence: Synthetic oligonucleotide"
aauuugcuuguggacccug

SEQ ID NO: 8214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuugcuuguggacccugtt

SEQ ID NO: 8215 - RNA, 19 nt, Artificial Sequence
  source: /note="Description of Artificial Sequence: Synthetic oligonucleotide"
caggguccacaagcaaauu

SEQ ID NO: 8216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggguccacaagcaaauutt

SEQ ID NO: 8217 - RNA, 19 nt, Artificial Sequence
  source: /note="Description of Artificial Sequence: Synthetic oligonucleotide"
uguggacccugacacugcu

SEQ ID NO: 8218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggacccugacacugcutt

SEQ ID NO: 8219 - RNA, 19 nt, Artificial Sequence
  source: /note="Description of Artificial Sequence: Synthetic oligonucleotide"
agcagugucaggguccaca

SEQ ID NO: 8220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagugucaggguccacatt

SEQ ID NO: 8221 - RNA, 19 nt, Artificial Sequence
  source: /note="Description of Artificial Sequence: Synthetic oligonucleotide"
gcuguccucaagcucugcg

SEQ ID NO: 8222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguccucaagcucugcgtt

SEQ ID NO: 8223 - RNA, 19 nt, Artificial Sequence
  source: /note="Description of Artificial Sequence: Synthetic oligonucleotide"
cgcagagcuugaggacagc

SEQ ID NO: 8224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcagagcuugaggacagctt

SEQ ID NO: 8225 - RNA, 19 nt, Artificial Sequence
  source: /note="Description of Artificial Sequence: Synthetic oligonucleotide"
cucaagcucugcgauuuug

SEQ ID NO: 8226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaagcucugcgauuuugtt

SEQ ID NO: 8227 - RNA, 19 nt, Artificial Sequence
  source: /note="Description of Artificial Sequence: Synthetic oligonucleotide"
caaaaucgcagagcuugag

SEQ ID NO: 8228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaaucgcagagcuugagtt

SEQ ID NO: 8229 - RNA, 19 nt, Artificial Sequence
  source: /note="Description of Artificial Sequence: Synthetic oligonucleotide"
uuggcagugcaaagcagcu

SEQ ID NO: 8230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcagugcaaagcagcutt

SEQ ID NO: 8231 - RNA, 19 nt, Artificial Sequence
  source: /note="Description of Artificial Sequence: Synthetic oligonucleotide"
agcugcuuugcacugccaa

SEQ ID NO: 8232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugcuuugcacugccaatt

SEQ ID NO: 8233 - RNA, 19 nt, Artificial Sequence
  source: /note="Description of Artificial Sequence: Synthetic oligonucleotide"
uggcagugcaaagcagcug

SEQ ID NO: 8234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcagugcaaagcagcugtt

SEQ ID NO: 8235 - RNA, 19 nt, Artificial Sequence
  source: /note="Description of Artificial Sequence: Synthetic oligonucleotide"
cagcugcuuugcacugcca

SEQ ID NO: 8236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcugcuuugcacugccatt

SEQ ID NO: 8237 - RNA, 19 nt, Artificial Sequence
  source: /note="Description of Artificial Sequence: Synthetic oligonucleotide"
gaccagcuuguggagauca

SEQ ID NO: 8238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccagcuuguggagaucatt

SEQ ID NO: 8239 - RNA, 19 nt, Artificial Sequence
  source: /note="Description of Artificial Sequence: Synthetic oligonucleotide"
ugaucuccacaagcugguc

SEQ ID NO: 8240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucuccacaagcugguctt

SEQ ID NO: 8241 - RNA, 19 nt, Artificial Sequence
  source: /note="Description of Artificial Sequence: Synthetic oligonucleotide"
ccagggaacaaauccgaga

SEQ ID NO: 8242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagggaacaaauccgagatt

SEQ ID NO: 8243 - RNA, 19 nt, Artificial Sequence
  source: /note="Description of Artificial Sequence: Synthetic oligonucleotide"
ucucggauuuguucccugg

SEQ ID NO: 8244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucggauuuguucccuggtt

SEQ ID NO: 8245 - RNA, 19 nt, Artificial Sequence
  source: /note="Description of Artificial Sequence: Synthetic oligonucleotide"
ccucacuugagguccccag

SEQ ID NO: 8246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucacuugagguccccagtt

SEQ ID NO: 8247 - RNA, 19 nt, Artificial Sequence
  source: /note="Description of Artificial Sequence: Synthetic oligonucleotide"
cuggggaccucaagugagg

SEQ ID NO: 8248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggaccucaagugaggtt

SEQ ID NO: 8249 - RNA, 19 nt, Artificial Sequence
  source: /note="Description of Artificial Sequence: Synthetic oligonucleotide"
uccccagcaggcccugcuu

SEQ ID NO: 8250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccagcaggcccugcuutt

SEQ ID NO: 8251 - RNA, 19 nt, Artificial Sequence
  source: /note="Description of Artificial Sequence: Synthetic oligonucleotide"
aagcagggccugcugggga

SEQ ID NO: 8252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcagggccugcuggggatt

SEQ ID NO: 8253 - RNA, 19 nt, Artificial Sequence
  source: /note="Description of Artificial Sequence: Synthetic oligonucleotide"
ccccagcaggcccugcuuc

SEQ ID NO: 8254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagcaggcccugcuuctt

SEQ ID NO: 8255 - RNA, 19 nt, Artificial Sequence
  source: /note="Description of Artificial Sequence: Synthetic oligonucleotide"
gaagcagggccugcugggg

SEQ ID NO: 8256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcagggccugcuggggtt

SEQ ID NO: 8257 - RNA, 19 nt, Artificial Sequence
  source: /note="Description of Artificial Sequence: Synthetic oligonucleotide"
accccuccacguccaucug

SEQ ID NO: 8258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accccuccacguccaucugtt

SEQ ID NO: 8259 - RNA, 19 nt, Artificial Sequence
  source: /note="Description of Artificial Sequence: Synthetic oligonucleotide"
cagauggacguggaggggu

SEQ ID NO: 8260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauggacguggaggggutt

SEQ ID NO: 8261 - RNA, 19 nt, Artificial Sequence
  source: /note="Description of Artificial Sequence: Synthetic oligonucleotide"
ccccuccacguccaucugg

SEQ ID NO: 8262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuccacguccaucuggtt

SEQ ID NO: 8263 - RNA, 19 nt, Artificial Sequence
  source: /note="Description of Artificial Sequence: Synthetic oligonucleotide"
ccagauggacguggagggg

SEQ ID NO: 8264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagauggacguggaggggtt

SEQ ID NO: 8265 - RNA, 19 nt, Artificial Sequence
  source: /note="Description of Artificial Sequence: Synthetic oligonucleotide"
uccacguccaucugggaag

SEQ ID NO: 8266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacguccaucugggaagtt

SEQ ID NO: 8267 - RNA, 19 nt, Artificial Sequence
  source: /note="Description of Artificial Sequence: Synthetic oligonucleotide"
cuucccagauggacgugga

SEQ ID NO: 8268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucccagauggacguggatt

SEQ ID NO: 8269 - RNA, 19 nt, Artificial Sequence
  source: /note="Description of Artificial Sequence: Synthetic oligonucleotide"
uggcgcugggaagggggcc

SEQ ID NO: 8270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcgcugggaagggggcctt

SEQ ID NO: 8271 - RNA, 19 nt, Artificial Sequence
  source: /note="Description of Artificial Sequence: Synthetic oligonucleotide"
ggcccccuucccagcgcca

SEQ ID NO: 8272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccccuucccagcgccatt

SEQ ID NO: 8273 - RNA, 19 nt, Artificial Sequence
  source: /note="Description of Artificial Sequence: Synthetic oligonucleotide"
ggcgcugggaagggggcca

SEQ ID NO: 8274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcugggaagggggccatt

SEQ ID NO: 8275 - RNA, 19 nt, Artificial Sequence
  source: /note="Description of Artificial Sequence: Synthetic oligonucleotide"
uggcccccuucccagcgcc

SEQ ID NO: 8276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcccccuucccagcgcctt

SEQ ID NO: 8277 - RNA, 19 nt, Artificial Sequence
  source: /note="Description of Artificial Sequence: Synthetic oligonucleotide"
gccacagcccaucaagcuc

SEQ ID NO: 8278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacagcccaucaagcuctt

SEQ ID NO: 8279 - RNA, 19 nt, Artificial Sequence
  source: /note="Description of Artificial Sequence: Synthetic oligonucleotide"
gagcuugaugggcuguggc

SEQ ID NO: 8280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuugaugggcuguggctt

SEQ ID NO: 8281 - RNA, 19 nt, Artificial Sequence
  source: /note="Description of Artificial Sequence: Synthetic oligonucleotide"
agcccaucaagcuccugcc

SEQ ID NO: 8282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaucaagcuccugcctt

SEQ ID NO: 8283 - RNA, 19 nt, Artificial Sequence
  source: /note="Description of Artificial Sequence: Synthetic oligonucleotide"
ggcaggagcuugaugggcu

SEQ ID NO: 8284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaggagcuugaugggcutt

SEQ ID NO: 8285 - RNA, 19 nt, Artificial Sequence
  source: /note="Description of Artificial Sequence: Synthetic oligonucleotide"
agcuccugcccuggcuggg

SEQ ID NO: 8286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuccugcccuggcugggtt

SEQ ID NO: 8287 - RNA, 19 nt, Artificial Sequence
  source: /note="Description of Artificial Sequence: Synthetic oligonucleotide"
cccagccagggcaggagcu

SEQ ID NO: 8288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagccagggcaggagcutt

SEQ ID NO: 8289 - RNA, 19 nt, Artificial Sequence
  source: /note="Description of Artificial Sequence: Synthetic oligonucleotide"
gcuccugcccuggcugggc

SEQ ID NO: 8290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccugcccuggcugggctt

SEQ ID NO: 8291 - RNA, 19 nt, Artificial Sequence
  source: /note="Description of Artificial Sequence: Synthetic oligonucleotide"
gcccagccagggcaggagc

SEQ ID NO: 8292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccagccagggcaggagctt

SEQ ID NO: 8293 - RNA, 19 nt, Artificial Sequence
  source: /note="Description of Artificial Sequence: Synthetic oligonucleotide"
cuagagggcagagguaaau

SEQ ID NO: 8294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagagggcagagguaaautt

SEQ ID NO: 8295 - RNA, 19 nt, Artificial Sequence
  source: /note="Description of Artificial Sequence: Synthetic oligonucleotide"
auuuaccucugcccucuag

SEQ ID NO: 8296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuaccucugcccucuagtt

SEQ ID NO: 8297 - RNA, 19 nt, Artificial Sequence
  source: /note="Description of Artificial Sequence: Synthetic oligonucleotide"
gggcagagguaaaugaacu

SEQ ID NO: 8298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcagagguaaaugaacutt

SEQ ID NO: 8299 - RNA, 19 nt, Artificial Sequence
  source: /note="Description of Artificial Sequence: Synthetic oligonucleotide"
aguucauuuaccucugccc

SEQ ID NO: 8300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucauuuaccucugccctt

SEQ ID NO: 8301 - RNA, 19 nt, Artificial Sequence
  source: /note="Description of Artificial Sequence: Synthetic oligonucleotide"
cagagguaaaugaacuacc

SEQ ID NO: 8302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagguaaaugaacuacctt

SEQ ID NO: 8303 - RNA, 19 nt, Artificial Sequence
  source: /note="Description of Artificial Sequence: Synthetic oligonucleotide"
gguaguucauuuaccucug

SEQ ID NO: 8304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguaguucauuuaccucugtt

SEQ ID NO: 8305 - RNA, 19 nt, Artificial Sequence
  source: /note="Description of Artificial Sequence: Synthetic oligonucleotide"
accucuguggugggcuuuu

SEQ ID NO: 8306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucuguggugggcuuuutt

SEQ ID NO: 8307 - RNA, 19 nt, Artificial Sequence
  source: /note="Description of Artificial Sequence: Synthetic oligonucleotide"
aaaagcccaccacagaggu

SEQ ID NO: 8308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaagcccaccacagaggutt

SEQ ID NO: 8309 - RNA, 19 nt, Artificial Sequence
  source: /note="Description of Artificial Sequence: Synthetic oligonucleotide"
ugggcuuuuuaaagaggau

SEQ ID NO: 8310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcuuuuuaaagaggautt

SEQ ID NO: 8311 - RNA, 19 nt, Artificial Sequence
  source: /note="Description of Artificial Sequence: Synthetic oligonucleotide"
auccucuuuaaaaagccca

SEQ ID NO: 8312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccucuuuaaaaagcccatt

SEQ ID NO: 8313 - RNA, 19 nt, Artificial Sequence
  source: /note="Description of Artificial Sequence: Synthetic oligonucleotide"
uucccuucccuggcccccu

SEQ ID NO: 8314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccuucccuggcccccutt

SEQ ID NO: 8315 - RNA, 19 nt, Artificial Sequence
  source: /note="Description of Artificial Sequence: Synthetic oligonucleotide"
agggggccagggaagggaa

SEQ ID NO: 8316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggggccagggaagggaatt

SEQ ID NO: 8317 - RNA, 19 nt, Artificial Sequence
  source: /note="Description of Artificial Sequence: Synthetic oligonucleotide"
ggagccggagcccgaacgg

SEQ ID NO: 8318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagccggagcccgaacggtt

SEQ ID NO: 8319 - RNA, 19 nt, Artificial Sequence
  source: /note="Description of Artificial Sequence: Synthetic oligonucleotide"
ccguucgggcuccggcucc

SEQ ID NO: 8320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccguucgggcuccggcucctt

SEQ ID NO: 8321 - RNA, 19 nt, Artificial Sequence
  source: /note="Description of Artificial Sequence: Synthetic oligonucleotide"
caggggaggcggcggcaga

SEQ ID NO: 8322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggggaggcggcggcagatt

SEQ ID NO: 8323 - RNA, 19 nt, Artificial Sequence
  source: /note="Description of Artificial Sequence: Synthetic oligonucleotide"
ucugccgccgccuccccug

SEQ ID NO: 8324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugccgccgccuccccugtt

SEQ ID NO: 8325 - RNA, 19 nt, Artificial Sequence
  source: /note="Description of Artificial Sequence: Synthetic oligonucleotide"
aggggaggcggcggcagag

SEQ ID NO: 8326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggggaggcggcggcagagtt

SEQ ID NO: 8327 - RNA, 19 nt, Artificial Sequence
  source: /note="Description of Artificial Sequence: Synthetic oligonucleotide"
cucugccgccgccuccccu

SEQ ID NO: 8328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugccgccgccuccccutt

SEQ ID NO: 8329 - RNA, 19 nt, Artificial Sequence
  source: /note="Description of Artificial Sequence: Synthetic oligonucleotide"
ggggaggcggcggcagagg

SEQ ID NO: 8330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaggcggcggcagaggtt

SEQ ID NO: 8331 - RNA, 19 nt, Artificial Sequence
  source: /note="Description of Artificial Sequence: Synthetic oligonucleotide"
ccucugccgccgccucccc

SEQ ID NO: 8332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucugccgccgccucccctt

SEQ ID NO: 8333 - RNA, 19 nt, Artificial Sequence
  source: /note="Description of Artificial Sequence: Synthetic oligonucleotide"
ggaggcggcggcagaggca

SEQ ID NO: 8334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcggcggcagaggcatt

SEQ ID NO: 8335 - RNA, 19 nt, Artificial Sequence
  source: /note="Description of Artificial Sequence: Synthetic oligonucleotide"
ugccucugccgccgccucc

SEQ ID NO: 8336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccucugccgccgccucctt

SEQ ID NO: 8337 - RNA, 19 nt, Artificial Sequence
  source: /note="Description of Artificial Sequence: Synthetic oligonucleotide"
aggcagcggcgggggcagc

SEQ ID NO: 8338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcagcggcgggggcagctt

SEQ ID NO: 8339 - RNA, 19 nt, Artificial Sequence
  source: /note="Description of Artificial Sequence: Synthetic oligonucleotide"
gcugcccccgccgcugccu

SEQ ID NO: 8340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcccccgccgcugccutt

SEQ ID NO: 8341 - RNA, 19 nt, Artificial Sequence
  source: /note="Description of Artificial Sequence: Synthetic oligonucleotide"
ggcagcggcgggggcagcc

SEQ ID NO: 8342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcggcgggggcagcctt

SEQ ID NO: 8343 - RNA, 19 nt, Artificial Sequence
  source: /note="Description of Artificial Sequence: Synthetic oligonucleotide"
ggcugcccccgccgcugcc

SEQ ID NO: 8344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugcccccgccgcugcctt

SEQ ID NO: 8345 - RNA, 19 nt, Artificial Sequence
  source: /note="Description of Artificial Sequence: Synthetic oligonucleotide"
cgcggccugggccugcgcu

SEQ ID NO: 8346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcggccugggccugcgcutt

SEQ ID NO: 8347 - RNA, 19 nt, Artificial Sequence
  source: /note="Description of Artificial Sequence: Synthetic oligonucleotide"
agcgcaggcccaggccgcg

SEQ ID NO: 8348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgcaggcccaggccgcgtt

SEQ ID NO: 8349 - RNA, 19 nt, Artificial Sequence
  source: /note="Description of Artificial Sequence: Synthetic oligonucleotide"
cggaggcggaggugguggc

SEQ ID NO: 8350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaggcggaggugguggctt

SEQ ID NO: 8351 - RNA, 19 nt, Artificial Sequence
  source: /note="Description of Artificial Sequence: Synthetic oligonucleotide"
gccaccaccuccgccuccg

SEQ ID NO: 8352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaccaccuccgccuccgtt

SEQ ID NO: 8353 - RNA, 19 nt, Artificial Sequence
  source: /note="Description of Artificial Sequence: Synthetic oligonucleotide"
ggaggcggaggugguggcg

SEQ ID NO: 8354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcggaggugguggcgtt

SEQ ID NO: 8355 - RNA, 19 nt, Artificial Sequence
  source: /note="Description of Artificial Sequence: Synthetic oligonucleotide"
cgccaccaccuccgccucc

SEQ ID NO: 8356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccaccaccuccgccucctt

SEQ ID NO: 8357 - RNA, 19 nt, Artificial Sequence
  source: /note="Description of Artificial Sequence: Synthetic oligonucleotide"
gaggcggaggugguggcgg

SEQ ID NO: 8358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcggaggugguggcggtt

SEQ ID NO: 8359 - RNA, 19 nt, Artificial Sequence
  source: /note="Description of Artificial Sequence: Synthetic oligonucleotide"
ccgccaccaccuccgccuc

SEQ ID NO: 8360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccaccaccuccgccuctt

SEQ ID NO: 8361 - RNA, 19 nt, Artificial Sequence
  source: /note="Description of Artificial Sequence: Synthetic oligonucleotide"
ggcggaggugguggcggcg

SEQ ID NO: 8362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggaggugguggcggcgtt

SEQ ID NO: 8363 - RNA, 19 nt, Artificial Sequence
  source: /note="Description of Artificial Sequence: Synthetic oligonucleotide"
cgccgccaccaccuccgcc

SEQ ID NO: 8364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccgccaccaccuccgcctt

SEQ ID NO: 8365 - RNA, 19 nt, Artificial Sequence
  source: /note="Description of Artificial Sequence: Synthetic oligonucleotide"
gcggaggugguggcggcgg

SEQ ID NO: 8366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggaggugguggcggcggtt

SEQ ID NO: 8367 - RNA, 19 nt, Artificial Sequence
  source: /note="Description of Artificial Sequence: Synthetic oligonucleotide"
ccgccgccaccaccuccgc

SEQ ID NO: 8368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgccgccaccaccuccgctt

SEQ ID NO: 8369 - RNA, 19 nt, Artificial Sequence
  source: /note="Description of Artificial Sequence: Synthetic oligonucleotide"
gguggcggcggccccgggg

SEQ ID NO: 8370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggcggcggccccggggtt

SEQ ID NO: 8371 - RNA, 19 nt, Artificial Sequence
  source: /note="Description of Artificial Sequence: Synthetic oligonucleotide"
ccccggggccgccgccacc

SEQ ID NO: 8372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccggggccgccgccacctt

SEQ ID NO: 8373 - RNA, 19 nt, Artificial Sequence
  source: /note="Description of Artificial Sequence: Synthetic oligonucleotide"
guggcggcggccccggggg

SEQ ID NO: 8374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcggcggccccgggggtt

SEQ ID NO: 8375 - RNA, 19 nt, Artificial Sequence
  source: /note="Description of Artificial Sequence: Synthetic oligonucleotide"
cccccggggccgccgccac

SEQ ID NO: 8376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccggggccgccgccactt

SEQ ID NO: 8377 - RNA, 19 nt, Artificial Sequence
  source: /note="Description of Artificial Sequence: Synthetic oligonucleotide"
uggcggcggccccgggggc

SEQ ID NO: 8378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcggcggccccgggggctt

SEQ ID NO: 8379 - RNA, 19 nt, Artificial Sequence
  source: /note="Description of Artificial Sequence: Synthetic oligonucleotide"
gcccccggggccgccgcca

SEQ ID NO: 8380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccggggccgccgccatt

SEQ ID NO: 8381 - RNA, 19 nt, Artificial Sequence
  source: /note="Description of Artificial Sequence: Synthetic oligonucleotide"
ggcggcggccccgggggcu

SEQ ID NO: 8382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcggccccgggggcutt

SEQ ID NO: 8383 - RNA, 19 nt, Artificial Sequence
  source: /note="Description of Artificial Sequence: Synthetic oligonucleotide"
agcccccggggccgccgcc

SEQ ID NO: 8384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccccggggccgccgcctt

SEQ ID NO: 8385 - RNA, 19 nt, Artificial Sequence
  source: /note="Description of Artificial Sequence: Synthetic oligonucleotide"
gccucuggcccaggaggca

SEQ ID NO: 8386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucuggcccaggaggcatt

SEQ ID NO: 8387 - RNA, 19 nt, Artificial Sequence
  source: /note="Description of Artificial Sequence: Synthetic oligonucleotide"
ugccuccugggccagaggc

SEQ ID NO: 8388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccuccugggccagaggctt

SEQ ID NO: 8389 - RNA, 19 nt, Artificial Sequence
  source: /note="Description of Artificial Sequence: Synthetic oligonucleotide"
ccucuggcccaggaggcac

SEQ ID NO: 8390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuggcccaggaggcactt

SEQ ID NO: 8391 - RNA, 19 nt, Artificial Sequence
  source: /note="Description of Artificial Sequence: Synthetic oligonucleotide"
gugccuccugggccagagg

SEQ ID NO: 8392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugccuccugggccagaggtt

SEQ ID NO: 8393 - RNA, 19 nt, Artificial Sequence
  source: /note="Description of Artificial Sequence: Synthetic oligonucleotide"
ucuggcccaggaggcacug

SEQ ID NO: 8394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggcccaggaggcacugtt

SEQ ID NO: 8395 - RNA, 19 nt, Artificial Sequence
  source: /note="Description of Artificial Sequence: Synthetic oligonucleotide"
cagugccuccugggccaga

SEQ ID NO: 8396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugccuccugggccagatt

SEQ ID NO: 8397 - RNA, 19 nt, Artificial Sequence
  source: /note="Description of Artificial Sequence: Synthetic oligonucleotide"
cuggcccaggaggcacugg

SEQ ID NO: 8398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcccaggaggcacuggtt

SEQ ID NO: 8399 - RNA, 19 nt, Artificial Sequence
  source: /note="Description of Artificial Sequence: Synthetic oligonucleotide"
ccagugccuccugggccag

SEQ ID NO: 8400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagugccuccugggccagtt

SEQ ID NO: 8401 - RNA, 19 nt, Artificial Sequence
  source: /note="Description of Artificial Sequence: Synthetic oligonucleotide"
ggcccaggaggcacuggcg

SEQ ID NO: 8402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcccaggaggcacuggcgtt

SEQ ID NO: 8403 - RNA, 19 nt, Artificial Sequence
  source: /note="Description of Artificial Sequence: Synthetic oligonucleotide"
cgccagugccuccugggcc

SEQ ID NO: 8404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccagugccuccugggcctt

SEQ ID NO: 8405 - RNA, 19 nt, Artificial Sequence
  source: /note="Description of Artificial Sequence: Synthetic oligonucleotide"
uaugggugggggcguggga

SEQ ID NO: 8406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaugggugggggcgugggatt

SEQ ID NO: 8407 - RNA, 19 nt, Artificial Sequence
  source: /note="Description of Artificial Sequence: Synthetic oligonucleotide"
ucccacgcccccacccaua

SEQ ID NO: 8408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccacgcccccacccauatt

SEQ ID NO: 8409 - RNA, 19 nt, Artificial Sequence
  source: /note="Description of Artificial Sequence: Synthetic oligonucleotide"
gggugggggcgugggagcc

SEQ ID NO: 8410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggugggggcgugggagcctt

SEQ ID NO: 8411 - RNA, 19 nt, Artificial Sequence
  source: /note="Description of Artificial Sequence: Synthetic oligonucleotide"
ggcucccacgcccccaccc

SEQ ID NO: 8412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucccacgcccccaccctt

SEQ ID NO: 8413 - RNA, 19 nt, Artificial Sequence
  source: /note="Description of Artificial Sequence: Synthetic oligonucleotide"
ggugggggcgugggagccu

SEQ ID NO: 8414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugggggcgugggagccutt

SEQ ID NO: 8415 - RNA, 19 nt, Artificial Sequence
  source: /note="Description of Artificial Sequence: Synthetic oligonucleotide"
aggcucccacgcccccacc

SEQ ID NO: 8416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcucccacgcccccacctt

SEQ ID NO: 8417 - RNA, 19 nt, Artificial Sequence
  source: /note="Description of Artificial Sequence: Synthetic oligonucleotide"
ugggggcgugggagccucg

SEQ ID NO: 8418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggggcgugggagccucgtt

SEQ ID NO: 8419 - RNA, 19 nt, Artificial Sequence
  source: /note="Description of Artificial Sequence: Synthetic oligonucleotide"
cgaggcucccacgccccca

SEQ ID NO: 8420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaggcucccacgcccccatt

SEQ ID NO: 8421 - RNA, 19 nt, Artificial Sequence
  source: /note="Description of Artificial Sequence: Synthetic oligonucleotide"
gcgugggagccucgagcuc

SEQ ID NO: 8422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgugggagccucgagcuctt

SEQ ID NO: 8423 - RNA, 19 nt, Artificial Sequence
  source: /note="Description of Artificial Sequence: Synthetic oligonucleotide"
gagcucgaggcucccacgc

SEQ ID NO: 8424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcucgaggcucccacgctt

SEQ ID NO: 8425 - RNA, 19 nt, Artificial Sequence
  source: /note="Description of Artificial Sequence: Synthetic oligonucleotide"
cggcagcggcggaggaggc

SEQ ID NO: 8426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcagcggcggaggaggctt

SEQ ID NO: 8427 - RNA, 19 nt, Artificial Sequence
  source: /note="Description of Artificial Sequence: Synthetic oligonucleotide"
gccuccuccgccgcugccg

SEQ ID NO: 8428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuccuccgccgcugccgtt

SEQ ID NO: 8429 - RNA, 19 nt, Artificial Sequence
  source: /note="Description of Artificial Sequence: Synthetic oligonucleotide"
ggcagcggcggaggaggca

SEQ ID NO: 8430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcggcggaggaggcatt

SEQ ID NO: 8431 - RNA, 19 nt, Artificial Sequence
  source: /note="Description of Artificial Sequence: Synthetic oligonucleotide"
ugccuccuccgccgcugcc

SEQ ID NO: 8432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccuccuccgccgcugcctt

SEQ ID NO: 8433 - RNA, 19 nt, Artificial Sequence
  source: /note="Description of Artificial Sequence: Synthetic oligonucleotide"
gcggaggaggcagcggugg

SEQ ID NO: 8434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggaggaggcagcgguggtt

SEQ ID NO: 8435 - RNA, 19 nt, Artificial Sequence
  source: /note="Description of Artificial Sequence: Synthetic oligonucleotide"
ccaccgcugccuccuccgc

SEQ ID NO: 8436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccgcugccuccuccgctt

SEQ ID NO: 8437 - RNA, 19 nt, Artificial Sequence
  source: /note="Description of Artificial Sequence: Synthetic oligonucleotide"
cggaggaggcagcgguggc

SEQ ID NO: 8438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaggaggcagcgguggctt

SEQ ID NO: 8439 - RNA, 19 nt, Artificial Sequence
  source: /note="Description of Artificial Sequence: Synthetic oligonucleotide"
gccaccgcugccuccuccg

SEQ ID NO: 8440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaccgcugccuccuccgtt

SEQ ID NO: 8441 - RNA, 19 nt, Artificial Sequence
  source: /note="Description of Artificial Sequence: Synthetic oligonucleotide"
gaggcagcgguggccccgg

SEQ ID NO: 8442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcagcgguggccccggtt

SEQ ID NO: 8443 - RNA, 19 nt, Artificial Sequence
  source: /note="Description of Artificial Sequence: Synthetic oligonucleotide"
ccggggccaccgcugccuc

SEQ ID NO: 8444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggggccaccgcugccuctt

SEQ ID NO: 8445 - RNA, 19 nt, Artificial Sequence
  source: /note="Description of Artificial Sequence: Synthetic oligonucleotide"
aggcagcgguggccccggc

SEQ ID NO: 8446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcagcgguggccccggctt

SEQ ID NO: 8447 - RNA, 19 nt, Artificial Sequence
  source: /note="Description of Artificial Sequence: Synthetic oligonucleotide"
gccggggccaccgcugccu

SEQ ID NO: 8448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccggggccaccgcugccutt

SEQ ID NO: 8449 - RNA, 19 nt, Artificial Sequence
  source: /note="Description of Artificial Sequence: Synthetic oligonucleotide"
gggaaggugaccacagugg

SEQ ID NO: 8450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaaggugaccacaguggtt

SEQ ID NO: 8451 - RNA, 19 nt, Artificial Sequence
  source: /note="Description of Artificial Sequence: Synthetic oligonucleotide"
ccacuguggucaccuuccc

SEQ ID NO: 8452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuguggucaccuuccctt

SEQ ID NO: 8453 - RNA, 19 nt, Artificial Sequence
  source: /note="Description of Artificial Sequence: Synthetic oligonucleotide"
ggaaggugaccacaguggu

SEQ ID NO: 8454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaggugaccacaguggutt

SEQ ID NO: 8455 - RNA, 19 nt, Artificial Sequence
  source: /note="Description of Artificial Sequence: Synthetic oligonucleotide"
accacuguggucaccuucc

SEQ ID NO: 8456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuguggucaccuucctt

SEQ ID NO: 8457 - RNA, 19 nt, Artificial Sequence
  source: /note="Description of Artificial Sequence: Synthetic oligonucleotide"
aaggugaccacagugguag

SEQ ID NO: 8458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggugaccacagugguagtt

SEQ ID NO: 8459 - RNA, 19 nt, Artificial Sequence
  source: /note="Description of Artificial Sequence: Synthetic oligonucleotide"
cuaccacuguggucaccuu

SEQ ID NO: 8460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccacuguggucaccuutt

SEQ ID NO: 8461 - RNA, 19 nt, Artificial Sequence
  source: /note="Description of Artificial Sequence: Synthetic oligonucleotide"
guucccaagaaguggcuua

SEQ ID NO: 8462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucccaagaaguggcuuatt

SEQ ID NO: 8463 - RNA, 19 nt, Artificial Sequence
  source: /note="Description of Artificial Sequence: Synthetic oligonucleotide"
uaagccacuucuugggaac

SEQ ID NO: 8464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagccacuucuugggaactt

SEQ ID NO: 8465 - RNA, 19 nt, Artificial Sequence
  source: /note="Description of Artificial Sequence: Synthetic oligonucleotide"
agugauugguaauggcuca

SEQ ID NO: 8466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugauugguaauggcucatt

SEQ ID NO: 8467 - RNA, 19 nt, Artificial Sequence
  source: /note="Description of Artificial Sequence: Synthetic oligonucleotide"
ugagccauuaccaaucacu

SEQ ID NO: 8468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagccauuaccaaucacutt

SEQ ID NO: 8469 - RNA, 19 nt, Artificial Sequence
  source: /note="Description of Artificial Sequence: Synthetic oligonucleotide"
gugauugguaauggcucau

SEQ ID NO: 8470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugauugguaauggcucautt

SEQ ID NO: 8471 - RNA, 19 nt, Artificial Sequence
  source: /note="Description of Artificial Sequence: Synthetic oligonucleotide"
augagccauuaccaaucac

SEQ ID NO: 8472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augagccauuaccaaucactt

SEQ ID NO: 8473 - RNA, 19 nt, Artificial Sequence
  source: /note="Description of Artificial Sequence: Synthetic oligonucleotide"
ugguggccaucaagaaggu

SEQ ID NO: 8474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguggccaucaagaaggutt

SEQ ID NO: 8475 - RNA, 19 nt, Artificial Sequence
  source: /note="Description of Artificial Sequence: Synthetic oligonucleotide"
accuucuugauggccacca

SEQ ID NO: 8476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuucuugauggccaccatt

SEQ ID NO: 8477 - RNA, 19 nt, Artificial Sequence
  source: /note="Description of Artificial Sequence: Synthetic oligonucleotide"
ccaucaagaagguucuuca

SEQ ID NO: 8478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucaagaagguucuucatt

SEQ ID NO: 8479 - RNA, 19 nt, Artificial Sequence
  source: /note="Description of Artificial Sequence: Synthetic oligonucleotide"
ugaagaaccuucuugaugg

SEQ ID NO: 8480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaagaaccuucuugauggtt

SEQ ID NO: 8481 - RNA, 19 nt, Artificial Sequence
  source: /note="Description of Artificial Sequence: Synthetic oligonucleotide"
caucaagaagguucuucag

SEQ ID NO: 8482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagaagguucuucagtt

SEQ ID NO: 8483 - RNA, 19 nt, Artificial Sequence
  source: /note="Description of Artificial Sequence: Synthetic oligonucleotide"
cugaagaaccuucuugaug

SEQ ID NO: 8484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaagaaccuucuugaugtt

SEQ ID NO: 8485 - RNA, 19 nt, Artificial Sequence
  source: /note="Description of Artificial Sequence: Synthetic oligonucleotide"
agguucuucaggacaaaag

SEQ ID NO: 8486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguucuucaggacaaaagtt

SEQ ID NO: 8487 - RNA, 19 nt, Artificial Sequence
  source: /note="Description of Artificial Sequence: Synthetic oligonucleotide"
cuuuuguccugaagaaccu

SEQ ID NO: 8488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuuguccugaagaaccutt

SEQ ID NO: 8489 - RNA, 19 nt, Artificial Sequence
  source: /note="Description of Artificial Sequence: Synthetic oligonucleotide"
cguaagcuggaccacugca

SEQ ID NO: 8490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguaagcuggaccacugcatt

SEQ ID NO: 8491 - RNA, 19 nt, Artificial Sequence
  source: /note="Description of Artificial Sequence: Synthetic oligonucleotide"
ugcagugguccagcuuacg

SEQ ID NO: 8492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagugguccagcuuacgtt

SEQ ID NO: 8493 - RNA, 19 nt, Artificial Sequence
  source: /note="Description of Artificial Sequence: Synthetic oligonucleotide"
ccacugcaauauugugagg

SEQ ID NO: 8494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacugcaauauugugaggtt

SEQ ID NO: 8495 - RNA, 19 nt, Artificial Sequence
  source: /note="Description of Artificial Sequence: Synthetic oligonucleotide"
ccucacaauauugcagugg

SEQ ID NO: 8496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucacaauauugcaguggtt

SEQ ID NO: 8497 - RNA, 19 nt, Artificial Sequence
  source: /note="Description of Artificial Sequence: Synthetic oligonucleotide"
guacuuuuucuacuccagu

SEQ ID NO: 8498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuuuuucuacuccagutt

SEQ ID NO: 8499 - RNA, 19 nt, Artificial Sequence
  source: /note="Description of Artificial Sequence: Synthetic oligonucleotide"
acuggaguagaaaaaguac

SEQ ID NO: 8500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggaguagaaaaaguactt

SEQ ID NO: 8501 - RNA, 19 nt, Artificial Sequence
  source: /note="Description of Artificial Sequence: Synthetic oligonucleotide"
cuuuuucuacuccaguggg

SEQ ID NO: 8502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuuucuacuccagugggtt

SEQ ID NO: 8503 - RNA, 19 nt, Artificial Sequence
  source: /note="Description of Artificial Sequence: Synthetic oligonucleotide"
cccacuggaguagaaaaag

SEQ ID NO: 8504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccacuggaguagaaaaagtt

SEQ ID NO: 8505 - RNA, 19 nt, Artificial Sequence
  source: /note="Description of Artificial Sequence: Synthetic oligonucleotide"
cuacuccaguggggagaag

SEQ ID NO: 8506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacuccaguggggagaagtt

SEQ ID NO: 8507 - RNA, 19 nt, Artificial Sequence
  source: /note="Description of Artificial Sequence: Synthetic oligonucleotide"
cuucuccccacuggaguag

SEQ ID NO: 8508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuccccacuggaguagtt

SEQ ID NO: 8509 - RNA, 19 nt, Artificial Sequence
  source: /note="Description of Artificial Sequence: Synthetic oligonucleotide"
uccaguggggagaagaagg

SEQ ID NO: 8510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaguggggagaagaaggtt

SEQ ID NO: 8511 - RNA, 19 nt, Artificial Sequence
  source: /note="Description of Artificial Sequence: Synthetic oligonucleotide"
ccuucuucuccccacugga

SEQ ID NO: 8512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucuucuccccacuggatt

SEQ ID NO: 8513 - RNA, 19 nt, Artificial Sequence
  source: /note="Description of Artificial Sequence: Synthetic oligonucleotide"
caguggggagaagaaggac

SEQ ID NO: 8514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguggggagaagaaggactt

SEQ ID NO: 8515 - RNA, 19 nt, Artificial Sequence
  source: /note="Description of Artificial Sequence: Synthetic oligonucleotide"
guccuucuucuccccacug

SEQ ID NO: 8516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuucuucuccccacugtt

SEQ ID NO: 8517 - RNA, 19 nt, Artificial Sequence
  source: /note="Description of Artificial Sequence: Synthetic oligonucleotide"
aguggggagaagaaggacg

SEQ ID NO: 8518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggggagaagaaggacgtt

SEQ ID NO: 8519 - RNA, 19 nt, Artificial Sequence
  source: /note="Description of Artificial Sequence: Synthetic oligonucleotide"
cguccuucuucuccccacu

SEQ ID NO: 8520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguccuucuucuccccacutt

SEQ ID NO: 8521 - RNA, 19 nt, Artificial Sequence
  source: /note="Description of Artificial Sequence: Synthetic oligonucleotide"
aucuggugcuggaguaugu

SEQ ID NO: 8522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuggugcuggaguaugutt

SEQ ID NO: 8523 - RNA, 19 nt, Artificial Sequence
  source: /note="Description of Artificial Sequence: Synthetic oligonucleotide"
acauacuccagcaccagau

SEQ ID NO: 8524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauacuccagcaccagautt

SEQ ID NO: 8525 - RNA, 19 nt, Artificial Sequence
  source: /note="Description of Artificial Sequence: Synthetic oligonucleotide"
ucuggugcuggaguaugug

SEQ ID NO: 8526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggugcuggaguaugugtt

SEQ ID NO: 8527 - RNA, 19 nt, Artificial Sequence
  source: /note="Description of Artificial Sequence: Synthetic oligonucleotide"
cacauacuccagcaccaga

SEQ ID NO: 8528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacauacuccagcaccagatt

SEQ ID NO: 8529 - RNA, 19 nt, Artificial Sequence
  source: /note="Description of Artificial Sequence: Synthetic oligonucleotide"
cuggugcuggaguaugugc

SEQ ID NO: 8530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggugcuggaguaugugctt

SEQ ID NO: 8531 - RNA, 19 nt, Artificial Sequence
  source: /note="Description of Artificial Sequence: Synthetic oligonucleotide"
gcacauacuccagcaccag

SEQ ID NO: 8532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacauacuccagcaccagtt

SEQ ID NO: 8533 - RNA, 19 nt, Artificial Sequence
  source: /note="Description of Artificial Sequence: Synthetic oligonucleotide"
ccacuucaccaaggccaag

SEQ ID NO: 8534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuucaccaaggccaagtt

SEQ ID NO: 8535 - RNA, 19 nt, Artificial Sequence
  source: /note="Description of Artificial Sequence: Synthetic oligonucleotide"
cuuggccuuggugaagugg

SEQ ID NO: 8536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggccuuggugaaguggtt

SEQ ID NO: 8537 - RNA, 19 nt, Artificial Sequence
  source: /note="Description of Artificial Sequence: Synthetic oligonucleotide"
acuucaccaaggccaagcu

SEQ ID NO: 8538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucaccaaggccaagcutt

SEQ ID NO: 8539 - RNA, 19 nt, Artificial Sequence
  source: /note="Description of Artificial Sequence: Synthetic oligonucleotide"
agcuuggccuuggugaagu

SEQ ID NO: 8540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuggccuuggugaagutt

SEQ ID NO: 8541 - RNA, 19 nt, Artificial Sequence
  source: /note="Description of Artificial Sequence: Synthetic oligonucleotide"
uucaccaaggccaagcuga

SEQ ID NO: 8542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaccaaggccaagcugatt

SEQ ID NO: 8543 - RNA, 19 nt, Artificial Sequence
  source: /note="Description of Artificial Sequence: Synthetic oligonucleotide"
ucagcuuggccuuggugaa

SEQ ID NO: 8544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagcuuggccuuggugaatt

SEQ ID NO: 8545 - RNA, 19 nt, Artificial Sequence
  source: /note="Description of Artificial Sequence: Synthetic oligonucleotide"
accaaggccaagcugauca

SEQ ID NO: 8546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaaggccaagcugaucatt

SEQ ID NO: 8547 - RNA, 19 nt, Artificial Sequence
  source: /note="Description of Artificial Sequence: Synthetic oligonucleotide"
ugaucagcuuggccuuggu

SEQ ID NO: 8548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucagcuuggccuuggutt

SEQ ID NO: 8549 - RNA, 19 nt, Artificial Sequence
  source: /note="Description of Artificial Sequence: Synthetic oligonucleotide"
ccaaggccaagcugaucac

SEQ ID NO: 8550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggccaagcugaucactt

SEQ ID NO: 8551 - RNA, 19 nt, Artificial Sequence
  source: /note="Description of Artificial Sequence: Synthetic oligonucleotide"
gugaucagcuuggccuugg

SEQ ID NO: 8552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaucagcuuggccuuggtt

SEQ ID NO: 8553 - RNA, 19 nt, Artificial Sequence
  source: /note="Description of Artificial Sequence: Synthetic oligonucleotide"
auguaccagcucuuccgga

SEQ ID NO: 8554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguaccagcucuuccggatt

SEQ ID NO: 8555 - RNA, 19 nt, Artificial Sequence
  source: /note="Description of Artificial Sequence: Synthetic oligonucleotide"
uccggaagagcugguacau

SEQ ID NO: 8556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggaagagcugguacautt

SEQ ID NO: 8557 - RNA, 19 nt, Artificial Sequence
  source: /note="Description of Artificial Sequence: Synthetic oligonucleotide"
cuuccggagcuuggccuac

SEQ ID NO: 8558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccggagcuuggccuactt

SEQ ID NO: 8559 - RNA, 19 nt, Artificial Sequence
  source: /note="Description of Artificial Sequence: Synthetic oligonucleotide"
guaggccaagcuccggaag

SEQ ID NO: 8560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaggccaagcuccggaagtt

SEQ ID NO: 8561 - RNA, 19 nt, Artificial Sequence
  source: /note="Description of Artificial Sequence: Synthetic oligonucleotide"
uccucaagcucugcgauuu

SEQ ID NO: 8562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucaagcucugcgauuutt

SEQ ID NO: 8563 - RNA, 19 nt, Artificial Sequence
  source: /note="Description of Artificial Sequence: Synthetic oligonucleotide"
aaaucgcagagcuugagga

SEQ ID NO: 8564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaucgcagagcuugaggatt

SEQ ID NO: 8565 - RNA, 19 nt, Artificial Sequence
  source: /note="Description of Artificial Sequence: Synthetic oligonucleotide"
ccucaagcucugcgauuuu

SEQ ID NO: 8566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaagcucugcgauuuutt

SEQ ID NO: 8567 - RNA, 19 nt, Artificial Sequence
  source: /note="Description of Artificial Sequence: Synthetic oligonucleotide"
aaaaucgcagagcuugagg

SEQ ID NO: 8568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaucgcagagcuugaggtt

SEQ ID NO: 8569 - RNA, 19 nt, Artificial Sequence
  source: /note="Description of Artificial Sequence: Synthetic oligonucleotide"
aagcucugcgauuuuggca

SEQ ID NO: 8570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcucugcgauuuuggcatt

SEQ ID NO: 8571 - RNA, 19 nt, Artificial Sequence
  source: /note="Description of Artificial Sequence: Synthetic oligonucleotide"
ugccaaaaucgcagagcuu

SEQ ID NO: 8572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaaaaucgcagagcuutt

SEQ ID NO: 8573 - RNA, 19 nt, Artificial Sequence
  source: /note="Description of Artificial Sequence: Synthetic oligonucleotide"
uuuuggcagugcaaagcag

SEQ ID NO: 8574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuggcagugcaaagcagtt

SEQ ID NO: 8575 - RNA, 19 nt, Artificial Sequence
  source: /note="Description of Artificial Sequence: Synthetic oligonucleotide"
cugcuuugcacugccaaaa

SEQ ID NO: 8576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuuugcacugccaaaatt

SEQ ID NO: 8577 - RNA, 19 nt, Artificial Sequence
  source: /note="Description of Artificial Sequence: Synthetic oligonucleotide"
uuuggcagugcaaagcagc

SEQ ID NO: 8578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggcagugcaaagcagctt

SEQ ID NO: 8579 - RNA, 19 nt, Artificial Sequence
  source: /note="Description of Artificial Sequence: Synthetic oligonucleotide"
gcugcuuugcacugccaaa

SEQ ID NO: 8580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcuuugcacugccaaatt

SEQ ID NO: 8581 - RNA, 19 nt, Artificial Sequence
  source: /note="Description of Artificial Sequence: Synthetic oligonucleotide"
gcagugcaaagcagcuggu

SEQ ID NO: 8582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagugcaaagcagcuggutt

SEQ ID NO: 8583 - RNA, 19 nt, Artificial Sequence
  source: /note="Description of Artificial Sequence: Synthetic oligonucleotide"
accagcugcuuugcacugc

SEQ ID NO: 8584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcugcuuugcacugctt

SEQ ID NO: 8585 - RNA, 19 nt, Artificial Sequence
  source: /note="Description of Artificial Sequence: Synthetic oligonucleotide"
gguggaccagcuuguggag

SEQ ID NO: 8586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggaccagcuuguggagtt

SEQ ID NO: 8587 - RNA, 19 nt, Artificial Sequence
  source: /note="Description of Artificial Sequence: Synthetic oligonucleotide"
cuccacaagcugguccacc

SEQ ID NO: 8588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccacaagcugguccacctt

SEQ ID NO: 8589 - RNA, 19 nt, Artificial Sequence
  source: /note="Description of Artificial Sequence: Synthetic oligonucleotide"
guggaccagcuuguggaga

SEQ ID NO: 8590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggaccagcuuguggagatt

SEQ ID NO: 8591 - RNA, 19 nt, Artificial Sequence
  source: /note="Description of Artificial Sequence: Synthetic oligonucleotide"
ucuccacaagcugguccac

SEQ ID NO: 8592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccacaagcugguccactt

SEQ ID NO: 8593 - RNA, 19 nt, Artificial Sequence
  source: /note="Description of Artificial Sequence: Synthetic oligonucleotide"
accagcuuguggagaucau

SEQ ID NO: 8594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcuuguggagaucautt

SEQ ID NO: 8595 - RNA, 19 nt, Artificial Sequence
  source: /note="Description of Artificial Sequence: Synthetic oligonucleotide"
augaucuccacaagcuggu

SEQ ID NO: 8596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaucuccacaagcuggutt

SEQ ID NO: 8597 - RNA, 19 nt, Artificial Sequence
  source: /note="Description of Artificial Sequence: Synthetic oligonucleotide"
cagggaacaaauccgagag

SEQ ID NO: 8598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggaacaaauccgagagtt

SEQ ID NO: 8599 - RNA, 19 nt, Artificial Sequence
  source: /note="Description of Artificial Sequence: Synthetic oligonucleotide"
cucucggauuuguucccug

SEQ ID NO: 8600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucggauuuguucccugtt

SEQ ID NO: 8601 - RNA, 19 nt, Artificial Sequence
  source: /note="Description of Artificial Sequence: Synthetic oligonucleotide"
aaguucccccagaucaaag

SEQ ID NO: 8602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguucccccagaucaaagtt

SEQ ID NO: 8603 - RNA, 19 nt, Artificial Sequence
  source: /note="Description of Artificial Sequence: Synthetic oligonucleotide"
cuuugaucugggggaacuu

SEQ ID NO: 8604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugaucugggggaacuutt

SEQ ID NO: 8605 - RNA, 19 nt, Artificial Sequence
  source: /note="Description of Artificial Sequence: Synthetic oligonucleotide"
cccccagaucaaagcucac

SEQ ID NO: 8606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccagaucaaagcucactt

SEQ ID NO: 8607 - RNA, 19 nt, Artificial Sequence
  source: /note="Description of Artificial Sequence: Synthetic oligonucleotide"
gugagcuuugaucuggggg

SEQ ID NO: 8608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugagcuuugaucugggggtt

SEQ ID NO: 8609 - RNA, 19 nt, Artificial Sequence
  source: /note="Description of Artificial Sequence: Synthetic oligonucleotide"
ccccagaucaaagcucacc

SEQ ID NO: 8610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccagaucaaagcucacctt

SEQ ID NO: 8611 - RNA, 19 nt, Artificial Sequence
  source: /note="Description of Artificial Sequence: Synthetic oligonucleotide"
ggugagcuuugaucugggg

SEQ ID NO: 8612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugagcuuugaucuggggtt

SEQ ID NO: 8613 - RNA, 19 nt, Artificial Sequence
  source: /note="Description of Artificial Sequence: Synthetic oligonucleotide"
uggacaaagguguucaaau

SEQ ID NO: 8614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacaaagguguucaaautt

SEQ ID NO: 8615 - RNA, 19 nt, Artificial Sequence
  source: /note="Description of Artificial Sequence: Synthetic oligonucleotide"
auuugaacaccuuugucca

SEQ ID NO: 8616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugaacaccuuuguccatt

SEQ ID NO: 8617 - RNA, 19 nt, Artificial Sequence
  source: /note="Description of Artificial Sequence: Synthetic oligonucleotide"
ccucaaggcucuccccacu

SEQ ID NO: 8618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaaggcucuccccacutt

SEQ ID NO: 8619 - RNA, 19 nt, Artificial Sequence
  source: /note="Description of Artificial Sequence: Synthetic oligonucleotide"
aguggggagagccuugagg

SEQ ID NO: 8620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggggagagccuugaggtt

SEQ ID NO: 8621 - RNA, 19 nt, Artificial Sequence
  source: /note="Description of Artificial Sequence: Synthetic oligonucleotide"
aggcuugugcccacagcuu

SEQ ID NO: 8622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuugugcccacagcuutt

SEQ ID NO: 8623 - RNA, 19 nt, Artificial Sequence
  source: /note="Description of Artificial Sequence: Synthetic oligonucleotide"
aagcugugggcacaagccu

SEQ ID NO: 8624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcugugggcacaagccutt

SEQ ID NO: 8625 - RNA, 19 nt, Artificial Sequence
  source: /note="Description of Artificial Sequence: Synthetic oligonucleotide"
uugugcccacagcuucuuc

SEQ ID NO: 8626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugugcccacagcuucuuctt

SEQ ID NO: 8627 - RNA, 19 nt, Artificial Sequence
  source: /note="Description of Artificial Sequence: Synthetic oligonucleotide"
gaagaagcugugggcacaa

SEQ ID NO: 8628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaagcugugggcacaatt

SEQ ID NO: 8629 - RNA, 19 nt, Artificial Sequence
  source: /note="Description of Artificial Sequence: Synthetic oligonucleotide"
gugcccacagcuucuucga

SEQ ID NO: 8630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcccacagcuucuucgatt

SEQ ID NO: 8631 - RNA, 19 nt, Artificial Sequence
  source: /note="Description of Artificial Sequence: Synthetic oligonucleotide"
ucgaagaagcugugggcac

SEQ ID NO: 8632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaagaagcugugggcactt

SEQ ID NO: 8633 - RNA, 19 nt, Artificial Sequence
  source: /note="Description of Artificial Sequence: Synthetic oligonucleotide"
ugcccacagcuucuucgau

SEQ ID NO: 8634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccacagcuucuucgautt

SEQ ID NO: 8635 - RNA, 19 nt, Artificial Sequence
  source: /note="Description of Artificial Sequence: Synthetic oligonucleotide"
aucgaagaagcugugggca

SEQ ID NO: 8636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgaagaagcugugggcatt

SEQ ID NO: 8637 - RNA, 19 nt, Artificial Sequence
  source: /note="Description of Artificial Sequence: Synthetic oligonucleotide"
ccccuguucaacuucaguc

SEQ ID NO: 8638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccuguucaacuucaguctt

SEQ ID NO: 8639 - RNA, 19 nt, Artificial Sequence
  source: /note="Description of Artificial Sequence: Synthetic oligonucleotide"
gacugaaguugaacagggg

SEQ ID NO: 8640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacugaaguugaacaggggtt

SEQ ID NO: 8641 - RNA, 19 nt, Artificial Sequence
  source: /note="Description of Artificial Sequence: Synthetic oligonucleotide"
cccuguucaacuucagucc

SEQ ID NO: 8642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuguucaacuucagucctt

SEQ ID NO: 8643 - RNA, 19 nt, Artificial Sequence
  source: /note="Description of Artificial Sequence: Synthetic oligonucleotide"
ggacugaaguugaacaggg

SEQ ID NO: 8644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacugaaguugaacagggtt

SEQ ID NO: 8645 - RNA, 19 nt, Artificial Sequence
  source: /note="Description of Artificial Sequence: Synthetic oligonucleotide"
ccuguucaacuucaguccu

SEQ ID NO: 8646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuguucaacuucaguccutt

SEQ ID NO: 8647 - RNA, 19 nt, Artificial Sequence
  source: /note="Description of Artificial Sequence: Synthetic oligonucleotide"
aggacugaaguugaacagg

SEQ ID NO: 8648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacugaaguugaacaggtt

SEQ ID NO: 8649 - RNA, 19 nt, Artificial Sequence
  source: /note="Description of Artificial Sequence: Synthetic oligonucleotide"
cuguucaacuucaguccug

SEQ ID NO: 8650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguucaacuucaguccugtt

SEQ ID NO: 8651 - RNA, 19 nt, Artificial Sequence
  source: /note="Description of Artificial Sequence: Synthetic oligonucleotide"
caggacugaaguugaacag

SEQ ID NO: 8652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggacugaaguugaacagtt

SEQ ID NO: 8653 - RNA, 19 nt, Artificial Sequence
  source: /note="Description of Artificial Sequence: Synthetic oligonucleotide"
ucaucccuccucacuugag

SEQ ID NO: 8654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucccuccucacuugagtt

SEQ ID NO: 8655 - RNA, 19 nt, Artificial Sequence
  source: /note="Description of Artificial Sequence: Synthetic oligonucleotide"
cucaagugaggagggauga

SEQ ID NO: 8656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaagugaggagggaugatt

SEQ ID NO: 8657 - RNA, 19 nt, Artificial Sequence
  source: /note="Description of Artificial Sequence: Synthetic oligonucleotide"
caucccuccucacuugagg

SEQ ID NO: 8658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucccuccucacuugaggtt

SEQ ID NO: 8659 - RNA, 19 nt, Artificial Sequence
  source: /note="Description of Artificial Sequence: Synthetic oligonucleotide"
ccucaagugaggagggaug

SEQ ID NO: 8660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaagugaggagggaugtt

SEQ ID NO: 8661 - RNA, 19 nt, Artificial Sequence
  source: /note="Description of Artificial Sequence: Synthetic oligonucleotide"
cccuccucacuugaggucc

SEQ ID NO: 8662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuccucacuugaggucctt

SEQ ID NO: 8663 - RNA, 19 nt, Artificial Sequence
  source: /note="Description of Artificial Sequence: Synthetic oligonucleotide"
ggaccucaagugaggaggg

SEQ ID NO: 8664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccucaagugaggagggtt

SEQ ID NO: 8665 - RNA, 19 nt, Artificial Sequence
  source: /note="Description of Artificial Sequence: Synthetic oligonucleotide"
ccuccucacuugagguccc

SEQ ID NO: 8666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccucacuugagguccctt

SEQ ID NO: 8667 - RNA, 19 nt, Artificial Sequence
  source: /note="Description of Artificial Sequence: Synthetic oligonucleotide"
gggaccucaagugaggagg

SEQ ID NO: 8668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaccucaagugaggaggtt

SEQ ID NO: 8669 - RNA, 19 nt, Artificial Sequence
  source: /note="Description of Artificial Sequence: Synthetic oligonucleotide"
cuccucacuugaggucccc

SEQ ID NO: 8670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccucacuugaggucccctt

SEQ ID NO: 8671 - RNA, 19 nt, Artificial Sequence
  source: /note="Description of Artificial Sequence: Synthetic oligonucleotide"
ggggaccucaagugaggag

SEQ ID NO: 8672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggaccucaagugaggagtt

SEQ ID NO: 8673 - RNA, 19 nt, Artificial Sequence
  source: /note="Description of Artificial Sequence: Synthetic oligonucleotide"
acuugagguccccagcagg

SEQ ID NO: 8674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugagguccccagcaggtt

SEQ ID NO: 8675 - RNA, 19 nt, Artificial Sequence
  source: /note="Description of Artificial Sequence: Synthetic oligonucleotide"
ccugcuggggaccucaagu

SEQ ID NO: 8676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugcuggggaccucaagutt

SEQ ID NO: 8677 - RNA, 19 nt, Artificial Sequence
  source: /note="Description of Artificial Sequence: Synthetic oligonucleotide"
cuugagguccccagcaggc

SEQ ID NO: 8678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugagguccccagcaggctt

SEQ ID NO: 8679 - RNA, 19 nt, Artificial Sequence
  source: /note="Description of Artificial Sequence: Synthetic oligonucleotide"
gccugcuggggaccucaag

SEQ ID NO: 8680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugcuggggaccucaagtt

SEQ ID NO: 8681 - RNA, 19 nt, Artificial Sequence
  source: /note="Description of Artificial Sequence: Synthetic oligonucleotide"
uugagguccccagcaggcc

SEQ ID NO: 8682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugagguccccagcaggcctt

SEQ ID NO: 8683 - RNA, 19 nt, Artificial Sequence
  source: /note="Description of Artificial Sequence: Synthetic oligonucleotide"
ggccugcuggggaccucaa

SEQ ID NO: 8684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccugcuggggaccucaatt

SEQ ID NO: 8685 - RNA, 19 nt, Artificial Sequence
  source: /note="Description of Artificial Sequence: Synthetic oligonucleotide"
agguccccagcaggcccug

SEQ ID NO: 8686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguccccagcaggcccugtt

SEQ ID NO: 8687 - RNA, 19 nt, Artificial Sequence
  source: /note="Description of Artificial Sequence: Synthetic oligonucleotide"
cagggccugcuggggaccu

SEQ ID NO: 8688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggccugcuggggaccutt

SEQ ID NO: 8689 - RNA, 19 nt, Artificial Sequence
  source: /note="Description of Artificial Sequence: Synthetic oligonucleotide"
gguccccagcaggcccugc

SEQ ID NO: 8690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccccagcaggcccugctt

SEQ ID NO: 8691 - RNA, 19 nt, Artificial Sequence
  source: /note="Description of Artificial Sequence: Synthetic oligonucleotide"
gcagggccugcuggggacc

SEQ ID NO: 8692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagggccugcuggggacctt

SEQ ID NO: 8693 - RNA, 19 nt, Artificial Sequence
  source: /note="Description of Artificial Sequence: Synthetic oligonucleotide"
guccccagcaggcccugcu

SEQ ID NO: 8694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccccagcaggcccugcutt

SEQ ID NO: 8695 - RNA, 19 nt, Artificial Sequence
  source: /note="Description of Artificial Sequence: Synthetic oligonucleotide"
agcagggccugcuggggac

SEQ ID NO: 8696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagggccugcuggggactt

SEQ ID NO: 8697 - RNA, 19 nt, Artificial Sequence
  source: /note="Description of Artificial Sequence: Synthetic oligonucleotide"
agcaggcccugcuucuccc

SEQ ID NO: 8698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaggcccugcuucuccctt

SEQ ID NO: 8699 - RNA, 19 nt, Artificial Sequence
  source: /note="Description of Artificial Sequence: Synthetic oligonucleotide"
gggagaagcagggccugcu

SEQ ID NO: 8700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagaagcagggccugcutt

SEQ ID NO: 8701 - RNA, 19 nt, Artificial Sequence
  source: /note="Description of Artificial Sequence: Synthetic oligonucleotide"
cuuuaacugaagcucagac

SEQ ID NO: 8702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuaacugaagcucagactt

SEQ ID NO: 8703 - RNA, 19 nt, Artificial Sequence
  source: /note="Description of Artificial Sequence: Synthetic oligonucleotide"
gucugagcuucaguuaaag

SEQ ID NO: 8704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucugagcuucaguuaaagtt

SEQ ID NO: 8705 - RNA, 19 nt, Artificial Sequence
  source: /note="Description of Artificial Sequence: Synthetic oligonucleotide"
ucugaugccacaacugcua

SEQ ID NO: 8706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugaugccacaacugcuatt

SEQ ID NO: 8707 - RNA, 19 nt, Artificial Sequence
  source: /note="Description of Artificial Sequence: Synthetic oligonucleotide"
uagcaguuguggcaucaga

SEQ ID NO: 8708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcaguuguggcaucagatt

SEQ ID NO: 8709 - RNA, 19 nt, Artificial Sequence
  source: /note="Description of Artificial Sequence: Synthetic oligonucleotide"
cugaugccacaacugcuac

SEQ ID NO: 8710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaugccacaacugcuactt

SEQ ID NO: 8711 - RNA, 19 nt, Artificial Sequence
  source: /note="Description of Artificial Sequence: Synthetic oligonucleotide"
guagcaguuguggcaucag

SEQ ID NO: 8712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagcaguuguggcaucagtt

SEQ ID NO: 8713 - RNA, 19 nt, Artificial Sequence
  source: /note="Description of Artificial Sequence: Synthetic oligonucleotide"
ugaugccacaacugcuacc

SEQ ID NO: 8714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaugccacaacugcuacctt

SEQ ID NO: 8715 - RNA, 19 nt, Artificial Sequence
  source: /note="Description of Artificial Sequence: Synthetic oligonucleotide"
gguagcaguuguggcauca

SEQ ID NO: 8716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagcaguuguggcaucatt

SEQ ID NO: 8717 - RNA, 19 nt, Artificial Sequence
  source: /note="Description of Artificial Sequence: Synthetic oligonucleotide"
gaugccacaacugcuaccc

SEQ ID NO: 8718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugccacaacugcuaccctt

SEQ ID NO: 8719 - RNA, 19 nt, Artificial Sequence
  source: /note="Description of Artificial Sequence: Synthetic oligonucleotide"
ggguagcaguuguggcauc

SEQ ID NO: 8720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguagcaguuguggcauctt

SEQ ID NO: 8721 - RNA, 19 nt, Artificial Sequence
  source: /note="Description of Artificial Sequence: Synthetic oligonucleotide"
cacguccaucugggaaggc

SEQ ID NO: 8722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacguccaucugggaaggctt

SEQ ID NO: 8723 - RNA, 19 nt, Artificial Sequence
  source: /note="Description of Artificial Sequence: Synthetic oligonucleotide"
gccuucccagauggacgug

SEQ ID NO: 8724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuucccagauggacgugtt

SEQ ID NO: 8725 - RNA, 19 nt, Artificial Sequence
  source: /note="Description of Artificial Sequence: Synthetic oligonucleotide"
acguccaucugggaaggcc

SEQ ID NO: 8726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acguccaucugggaaggcctt

SEQ ID NO: 8727 - RNA, 19 nt, Artificial Sequence
  source: /note="Description of Artificial Sequence: Synthetic oligonucleotide"
ggccuucccagauggacgu

SEQ ID NO: 8728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccuucccagauggacgutt

SEQ ID NO: 8729 - RNA, 19 nt, Artificial Sequence
  source: /note="Description of Artificial Sequence: Synthetic oligonucleotide"
cguccaucugggaaggccc

SEQ ID NO: 8730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguccaucugggaaggccctt

SEQ ID NO: 8731 - RNA, 19 nt, Artificial Sequence
  source: /note="Description of Artificial Sequence: Synthetic oligonucleotide"
gggccuucccagauggacg

SEQ ID NO: 8732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccuucccagauggacgtt

SEQ ID NO: 8733 - RNA, 19 nt, Artificial Sequence
  source: /note="Description of Artificial Sequence: Synthetic oligonucleotide"
guccaucugggaaggccca

SEQ ID NO: 8734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaucugggaaggcccatt

SEQ ID NO: 8735 - RNA, 19 nt, Artificial Sequence
  source: /note="Description of Artificial Sequence: Synthetic oligonucleotide"
ugggccuucccagauggac

SEQ ID NO: 8736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccuucccagauggactt

SEQ ID NO: 8737 - RNA, 19 nt, Artificial Sequence
  source: /note="Description of Artificial Sequence: Synthetic oligonucleotide"
ucugggaaggcccaagugg

SEQ ID NO: 8738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugggaaggcccaaguggtt

SEQ ID NO: 8739 - RNA, 19 nt, Artificial Sequence
  source: /note="Description of Artificial Sequence: Synthetic oligonucleotide"
ccacuugggccuucccaga

SEQ ID NO: 8740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuugggccuucccagatt

SEQ ID NO: 8741 - RNA, 19 nt, Artificial Sequence
  source: /note="Description of Artificial Sequence: Synthetic oligonucleotide"
cugggaaggcccaaguggc

SEQ ID NO: 8742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggaaggcccaaguggctt

SEQ ID NO: 8743 - RNA, 19 nt, Artificial Sequence
  source: /note="Description of Artificial Sequence: Synthetic oligonucleotide"
gccacuugggccuucccag

SEQ ID NO: 8744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacuugggccuucccagtt

SEQ ID NO: 8745 - RNA, 19 nt, Artificial Sequence
  source: /note="Description of Artificial Sequence: Synthetic oligonucleotide"
guggcgcugggaagggggc

SEQ ID NO: 8746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcgcugggaagggggctt

SEQ ID NO: 8747 - RNA, 19 nt, Artificial Sequence
  source: /note="Description of Artificial Sequence: Synthetic oligonucleotide"
gcccccuucccagcgccac

SEQ ID NO: 8748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccccuucccagcgccactt

SEQ ID NO: 8749 - RNA, 19 nt, Artificial Sequence
  source: /note="Description of Artificial Sequence: Synthetic oligonucleotide"
gcugggaagggggccacag

SEQ ID NO: 8750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugggaagggggccacagtt

SEQ ID NO: 8751 - RNA, 19 nt, Artificial Sequence
  source: /note="Description of Artificial Sequence: Synthetic oligonucleotide"
cuguggcccccuucccagc

SEQ ID NO: 8752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggcccccuucccagctt

SEQ ID NO: 8753 - RNA, 19 nt, Artificial Sequence
  source: /note="Description of Artificial Sequence: Synthetic oligonucleotide"
gggggccacagcccaucaa

SEQ ID NO: 8754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggccacagcccaucaatt

SEQ ID NO: 8755 - RNA, 19 nt, Artificial Sequence
  source: /note="Description of Artificial Sequence: Synthetic oligonucleotide"
uugaugggcuguggccccc

SEQ ID NO: 8756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaugggcuguggccccctt

SEQ ID NO: 8757 - RNA, 19 nt, Artificial Sequence
  source: /note="Description of Artificial Sequence: Synthetic oligonucleotide"
ggggccacagcccaucaag

SEQ ID NO: 8758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccacagcccaucaagtt

SEQ ID NO: 8759 - RNA, 19 nt, Artificial Sequence
  source: /note="Description of Artificial Sequence: Synthetic oligonucleotide"
cuugaugggcuguggcccc

SEQ ID NO: 8760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugaugggcuguggcccctt

SEQ ID NO: 8761 - RNA, 19 nt, Artificial Sequence
  source: /note="Description of Artificial Sequence: Synthetic oligonucleotide"
gcccaucaagcuccugccc

SEQ ID NO: 8762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaucaagcuccugccctt

SEQ ID NO: 8763 - RNA, 19 nt, Artificial Sequence
  source: /note="Description of Artificial Sequence: Synthetic oligonucleotide"
gggcaggagcuugaugggc

SEQ ID NO: 8764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcaggagcuugaugggctt

SEQ ID NO: 8765 - RNA, 19 nt, Artificial Sequence
  source: /note="Description of Artificial Sequence: Synthetic oligonucleotide"
ucaagcuccugcccuggcu

SEQ ID NO: 8766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagcuccugcccuggcutt

SEQ ID NO: 8767 - RNA, 19 nt, Artificial Sequence
  source: /note="Description of Artificial Sequence: Synthetic oligonucleotide"
agccagggcaggagcuuga

SEQ ID NO: 8768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccagggcaggagcuugatt

SEQ ID NO: 8769 - RNA, 19 nt, Artificial Sequence
  source: /note="Description of Artificial Sequence: Synthetic oligonucleotide"
uccugcccuggcugggccc

SEQ ID NO: 8770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugcccuggcugggccctt

SEQ ID NO: 8771 - RNA, 19 nt, Artificial Sequence
  source: /note="Description of Artificial Sequence: Synthetic oligonucleotide"
gggcccagccagggcagga

SEQ ID NO: 8772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcccagccagggcaggatt

SEQ ID NO: 8773 - RNA, 19 nt, Artificial Sequence
  source: /note="Description of Artificial Sequence: Synthetic oligonucleotide"
ccugcccuggcugggcccc

SEQ ID NO: 8774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugcccuggcugggcccctt

SEQ ID NO: 8775 - RNA, 19 nt, Artificial Sequence
  source: /note="Description of Artificial Sequence: Synthetic oligonucleotide"
ggggcccagccagggcagg

SEQ ID NO: 8776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcccagccagggcaggtt

SEQ ID NO: 8777 - RNA, 19 nt, Artificial Sequence
  source: /note="Description of Artificial Sequence: Synthetic oligonucleotide"
ugcccuggcugggccccua

SEQ ID NO: 8778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccuggcugggccccuatt

SEQ ID NO: 8779 - RNA, 19 nt, Artificial Sequence
  source: /note="Description of Artificial Sequence: Synthetic oligonucleotide"
uaggggcccagccagggca

SEQ ID NO: 8780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggggcccagccagggcatt

SEQ ID NO: 8781 - RNA, 19 nt, Artificial Sequence
  source: /note="Description of Artificial Sequence: Synthetic oligonucleotide"
cccuggcugggccccuaga

SEQ ID NO: 8782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggcugggccccuagatt

SEQ ID NO: 8783 - RNA, 19 nt, Artificial Sequence
  source: /note="Description of Artificial Sequence: Synthetic oligonucleotide"
ucuaggggcccagccaggg

SEQ ID NO: 8784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuaggggcccagccagggtt

SEQ ID NO: 8785 - RNA, 19 nt, Artificial Sequence
  source: /note="Description of Artificial Sequence: Synthetic oligonucleotide"
agagggcagagguaaauga

SEQ ID NO: 8786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagggcagagguaaaugatt

SEQ ID NO: 8787 - RNA, 19 nt, Artificial Sequence
  source: /note="Description of Artificial Sequence: Synthetic oligonucleotide"
ucauuuaccucugcccucu

SEQ ID NO: 8788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauuuaccucugcccucutt

SEQ ID NO: 8789 - RNA, 19 nt, Artificial Sequence
  source: /note="Description of Artificial Sequence: Synthetic oligonucleotide"
gagggcagagguaaaugaa

SEQ ID NO: 8790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggcagagguaaaugaatt

SEQ ID NO: 8791 - RNA, 19 nt, Artificial Sequence
  source: /note="Description of Artificial Sequence: Synthetic oligonucleotide"
uucauuuaccucugcccuc

SEQ ID NO: 8792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucauuuaccucugcccuctt

SEQ ID NO: 8793 - RNA, 19 nt, Artificial Sequence
  source: /note="Description of Artificial Sequence: Synthetic oligonucleotide"
gcaucuaggccucccucag

SEQ ID NO: 8794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaucuaggccucccucagtt

SEQ ID NO: 8795 - RNA, 19 nt, Artificial Sequence
  source: /note="Description of Artificial Sequence: Synthetic oligonucleotide"
cugagggaggccuagaugc

SEQ ID NO: 8796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugagggaggccuagaugctt

SEQ ID NO: 8797 - RNA, 19 nt, Artificial Sequence
  source: /note="Description of Artificial Sequence: Synthetic oligonucleotide"
ccucuguggugggcuuuuu

SEQ ID NO: 8798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuguggugggcuuuuutt

SEQ ID NO: 8799 - RNA, 19 nt, Artificial Sequence
  source: /note="Description of Artificial Sequence: Synthetic oligonucleotide"
aaaaagcccaccacagagg

SEQ ID NO: 8800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaaagcccaccacagaggtt

SEQ ID NO: 8801 - RNA, 19 nt, Artificial Sequence
  source: /note="Description of Artificial Sequence: Synthetic oligonucleotide"
uggugggcuuuuuaaagag

SEQ ID NO: 8802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugggcuuuuuaaagagtt

SEQ ID NO: 8803 - RNA, 19 nt, Artificial Sequence
  source: /note="Description of Artificial Sequence: Synthetic oligonucleotide"
cucuuuaaaaagcccacca

SEQ ID NO: 8804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuuuaaaaagcccaccatt

SEQ ID NO: 8805 - RNA, 19 nt, Artificial Sequence
  source: /note="Description of Artificial Sequence: Synthetic oligonucleotide"
gugggcuuuuuaaagagga

SEQ ID NO: 8806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugggcuuuuuaaagaggatt

SEQ ID NO: 8807 - RNA, 19 nt, Artificial Sequence
  source: /note="Description of Artificial Sequence: Synthetic oligonucleotide"
uccucuuuaaaaagcccac

SEQ ID NO: 8808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucuuuaaaaagcccactt

SEQ ID NO: 8809 - RNA, 19 nt, Artificial Sequence
  source: /note="Description of Artificial Sequence: Synthetic oligonucleotide"
gcuuuuuaaagaggauuuu

SEQ ID NO: 8810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuuuuaaagaggauuuutt

SEQ ID NO: 8811 - RNA, 19 nt, Artificial Sequence
  source: /note="Description of Artificial Sequence: Synthetic oligonucleotide"
aaaauccucuuuaaaaagc

SEQ ID NO: 8812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaauccucuuuaaaaagctt

SEQ ID NO: 8813 - RNA, 19 nt, Artificial Sequence
  source: /note="Description of Artificial Sequence: Synthetic oligonucleotide"
cuuuuuaaagaggauuuua

SEQ ID NO: 8814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuuuaaagaggauuuuatt

SEQ ID NO: 8815 - RNA, 19 nt, Artificial Sequence
  source: /note="Description of Artificial Sequence: Synthetic oligonucleotide"
uaaaauccucuuuaaaaag

SEQ ID NO: 8816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaauccucuuuaaaaagtt

SEQ ID NO: 8817 - RNA, 19 nt, Artificial Sequence
  source: /note="Description of Artificial Sequence: Synthetic oligonucleotide"
ggaggggagaaaaggaagg

SEQ ID NO: 8818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggggagaaaaggaaggtt

SEQ ID NO: 8819 - RNA, 19 nt, Artificial Sequence
  source: /note="Description of Artificial Sequence: Synthetic oligonucleotide"
ccuuccuuuucuccccucc

SEQ ID NO: 8820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuccuuuucuccccucctt

SEQ ID NO: 8821 - RNA, 19 nt, Artificial Sequence
  source: /note="Description of Artificial Sequence: Synthetic oligonucleotide"
gaggggagaaaaggaagga

SEQ ID NO: 8822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggggagaaaaggaaggatt

SEQ ID NO: 8823 - RNA, 19 nt, Artificial Sequence
  source: /note="Description of Artificial Sequence: Synthetic oligonucleotide"
uccuuccuuuucuccccuc

SEQ ID NO: 8824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuccuuuucuccccuctt

SEQ ID NO: 8825 - RNA, 19 nt, Artificial Sequence
  source: /note="Description of Artificial Sequence: Synthetic oligonucleotide"
acgggguuuggggguguga

SEQ ID NO: 8826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgggguuugggggugugatt

SEQ ID NO: 8827 - RNA, 19 nt, Artificial Sequence
  source: /note="Description of Artificial Sequence: Synthetic oligonucleotide"
ucacacccccaaaccccgu

SEQ ID NO: 8828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacacccccaaaccccgutt

SEQ ID NO: 8829 - RNA, 19 nt, Artificial Sequence
  source: /note="Description of Artificial Sequence: Synthetic oligonucleotide"
ugguccccuccccuccccc

SEQ ID NO: 8830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguccccuccccuccccctt

SEQ ID NO: 8831 - RNA, 19 nt, Artificial Sequence
  source: /note="Description of Artificial Sequence: Synthetic oligonucleotide"
gggggaggggaggggacca

SEQ ID NO: 8832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggggaggggaggggaccatt

SEQ ID NO: 8833 - RNA, 19 nt, Artificial Sequence
  source: /note="Description of Artificial Sequence: Synthetic oligonucleotide"
gguccccuccccuccccca

SEQ ID NO: 8834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccccuccccucccccatt

SEQ ID NO: 8835 - RNA, 19 nt, Artificial Sequence
  source: /note="Description of Artificial Sequence: Synthetic oligonucleotide"
ugggggaggggaggggacc

SEQ ID NO: 8836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggggaggggaggggacctt

SEQ ID NO: 8837 - RNA, 19 nt, Artificial Sequence
  source: /note="Description of Artificial Sequence: Synthetic oligonucleotide"
uccccucccccaggcuacc

SEQ ID NO: 8838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccucccccaggcuacctt

SEQ ID NO: 8839 - RNA, 19 nt, Artificial Sequence
  source: /note="Description of Artificial Sequence: Synthetic oligonucleotide"
gguagccugggggagggga

SEQ ID NO: 8840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagccugggggaggggatt

SEQ ID NO: 8841 - RNA, 19 nt, Artificial Sequence
  source: /note="Description of Artificial Sequence: Synthetic oligonucleotide"
ccccccucucccagguccc

SEQ ID NO: 8842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccccucucccagguccctt

SEQ ID NO: 8843 - RNA, 19 nt, Artificial Sequence
  source: /note="Description of Artificial Sequence: Synthetic oligonucleotide"
gggaccugggagagggggg

SEQ ID NO: 8844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaccugggagaggggggtt

SEQ ID NO: 8845 - RNA, 19 nt, Artificial Sequence
  source: /note="Description of Artificial Sequence: Synthetic oligonucleotide"
cccccucucccaggucccu

SEQ ID NO: 8846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccccucucccaggucccutt

SEQ ID NO: 8847 - RNA, 19 nt, Artificial Sequence
  source: /note="Description of Artificial Sequence: Synthetic oligonucleotide"
agggaccugggagaggggg

SEQ ID NO: 8848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaccugggagagggggtt

SEQ ID NO: 8849 - RNA, 19 nt, Artificial Sequence
  source: /note="Description of Artificial Sequence: Synthetic oligonucleotide"
ccaaggcuuccucccucuc

SEQ ID NO: 8850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggcuuccucccucuctt

SEQ ID NO: 8851 - RNA, 19 nt, Artificial Sequence
  source: /note="Description of Artificial Sequence: Synthetic oligonucleotide"
gagagggaggaagccuugg

SEQ ID NO: 8852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagggaggaagccuuggtt

SEQ ID NO: 8853 - RNA, 19 nt, Artificial Sequence
  source: /note="Description of Artificial Sequence: Synthetic oligonucleotide"
uuccucccucuccccaucc

SEQ ID NO: 8854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccucccucuccccaucctt

SEQ ID NO: 8855 - RNA, 19 nt, Artificial Sequence
  source: /note="Description of Artificial Sequence: Synthetic oligonucleotide"
ggauggggagagggaggaa

SEQ ID NO: 8856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauggggagagggaggaatt

SEQ ID NO: 8857 - RNA, 19 nt, Artificial Sequence
  source: /note="Description of Artificial Sequence: Synthetic oligonucleotide"
ugggccggagccggagccc

SEQ ID NO: 8858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggccggagccggagccctt

SEQ ID NO: 8859 - RNA, 19 nt, Artificial Sequence
  source: /note="Description of Artificial Sequence: Synthetic oligonucleotide"
gggcuccggcuccggccca

SEQ ID NO: 8860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcuccggcuccggcccatt

SEQ ID NO: 8861 - RNA, 19 nt, Artificial Sequence
  source: /note="Description of Artificial Sequence: Synthetic oligonucleotide"
ggccggagccggagcccga

SEQ ID NO: 8862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccggagccggagcccgatt

SEQ ID NO: 8863 - RNA, 19 nt, Artificial Sequence
  source: /note="Description of Artificial Sequence: Synthetic oligonucleotide"
ucgggcuccggcuccggcc

SEQ ID NO: 8864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgggcuccggcuccggcctt

SEQ ID NO: 8865 - RNA, 19 nt, Artificial Sequence
  source: /note="Description of Artificial Sequence: Synthetic oligonucleotide"
gccggagccggagcccgaa

SEQ ID NO: 8866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccggagccggagcccgaatt

SEQ ID NO: 8867 - RNA, 19 nt, Artificial Sequence
  source: /note="Description of Artificial Sequence: Synthetic oligonucleotide"
uucgggcuccggcuccggc

SEQ ID NO: 8868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucgggcuccggcuccggctt

SEQ ID NO: 8869 - RNA, 19 nt, Artificial Sequence
  source: /note="Description of Artificial Sequence: Synthetic oligonucleotide"
gggaggcggcggcagaggc

SEQ ID NO: 8870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaggcggcggcagaggctt

SEQ ID NO: 8871 - RNA, 19 nt, Artificial Sequence
  source: /note="Description of Artificial Sequence: Synthetic oligonucleotide"
gccucugccgccgccuccc

SEQ ID NO: 8872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucugccgccgccuccctt

SEQ ID NO: 8873 - RNA, 19 nt, Artificial Sequence
  source: /note="Description of Artificial Sequence: Synthetic oligonucleotide"
aggcggcggcagaggcagc

SEQ ID NO: 8874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcggcggcagaggcagctt

SEQ ID NO: 8875 - RNA, 19 nt, Artificial Sequence
  source: /note="Description of Artificial Sequence: Synthetic oligonucleotide"
gcugccucugccgccgccu

SEQ ID NO: 8876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccucugccgccgccutt

SEQ ID NO: 8877 - RNA, 19 nt, Artificial Sequence
  source: /note="Description of Artificial Sequence: Synthetic oligonucleotide"
ggcggcggcagaggcagcg

SEQ ID NO: 8878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcggcagaggcagcgtt

SEQ ID NO: 8879 - RNA, 19 nt, Artificial Sequence
  source: /note="Description of Artificial Sequence: Synthetic oligonucleotide"
cgcugccucugccgccgcc

SEQ ID NO: 8880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcugccucugccgccgcctt

SEQ ID NO: 8881 - RNA, 19 nt, Artificial Sequence
  source: /note="Description of Artificial Sequence: Synthetic oligonucleotide"
agaggcagcggcgggggca

SEQ ID NO: 8882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggcagcggcgggggcatt

SEQ ID NO: 8883 - RNA, 19 nt, Artificial Sequence
  source: /note="Description of Artificial Sequence: Synthetic oligonucleotide"
ugcccccgccgcugccucu

SEQ ID NO: 8884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccccgccgcugccucutt

SEQ ID NO: 8885 - RNA, 19 nt, Artificial Sequence
  source: /note="Description of Artificial Sequence: Synthetic oligonucleotide"
gaggcagcggcgggggcag

SEQ ID NO: 8886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcagcggcgggggcagtt

SEQ ID NO: 8887 - RNA, 19 nt, Artificial Sequence
  source: /note="Description of Artificial Sequence: Synthetic oligonucleotide"
cugcccccgccgcugccuc

SEQ ID NO: 8888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcccccgccgcugccuctt

SEQ ID NO: 8889 - RNA, 19 nt, Artificial Sequence
  source: /note="Description of Artificial Sequence: Synthetic oligonucleotide"
caggaggcggaggcggagg

SEQ ID NO: 8890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaggcggaggcggaggtt

SEQ ID NO: 8891 - RNA, 19 nt, Artificial Sequence
  source: /note="Description of Artificial Sequence: Synthetic oligonucleotide"
ccuccgccuccgccuccug

SEQ ID NO: 8892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccgccuccgccuccugtt

SEQ ID NO: 8893 - RNA, 19 nt, Artificial Sequence
  source: /note="Description of Artificial Sequence: Synthetic oligonucleotide"
aggaggcggaggcggaggu

SEQ ID NO: 8894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaggcggaggcggaggutt

SEQ ID NO: 8895 - RNA, 19 nt, Artificial Sequence
  source: /note="Description of Artificial Sequence: Synthetic oligonucleotide"
accuccgccuccgccuccu

SEQ ID NO: 8896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuccgccuccgccuccutt

SEQ ID NO: 8897 - RNA, 19 nt, Artificial Sequence
  source: /note="Description of Artificial Sequence: Synthetic oligonucleotide"
aggcggaggcggagguggu

SEQ ID NO: 8898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcggaggcggagguggutt

SEQ ID NO: 8899 - RNA, 19 nt, Artificial Sequence
  source: /note="Description of Artificial Sequence: Synthetic oligonucleotide"
accaccuccgccuccgccu

SEQ ID NO: 8900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaccuccgccuccgccutt

SEQ ID NO: 8901 - RNA, 19 nt, Artificial Sequence
  source: /note="Description of Artificial Sequence: Synthetic oligonucleotide"
aggcggaggugguggcggc

SEQ ID NO: 8902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcggaggugguggcggctt

SEQ ID NO: 8903 - RNA, 19 nt, Artificial Sequence
  source: /note="Description of Artificial Sequence: Synthetic oligonucleotide"
gccgccaccaccuccgccu

SEQ ID NO: 8904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccaccaccuccgccutt

SEQ ID NO: 8905 - RNA, 19 nt, Artificial Sequence
  source: /note="Description of Artificial Sequence: Synthetic oligonucleotide"
cggaggugguggcggcggc

SEQ ID NO: 8906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaggugguggcggcggctt

SEQ ID NO: 8907 - RNA, 19 nt, Artificial Sequence
  source: /note="Description of Artificial Sequence: Synthetic oligonucleotide"
gccgccgccaccaccuccg

SEQ ID NO: 8908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgccgccaccaccuccgtt

SEQ ID NO: 8909 - RNA, 19 nt, Artificial Sequence
  source: /note="Description of Artificial Sequence: Synthetic oligonucleotide"
ggaggugguggcggcggcc

SEQ ID NO: 8910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggugguggcggcggcctt

SEQ ID NO: 8911 - RNA, 19 nt, Artificial Sequence
  source: /note="Description of Artificial Sequence: Synthetic oligonucleotide"
ggccgccgccaccaccucc

SEQ ID NO: 8912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccgccgccaccaccucctt

SEQ ID NO: 8913 - RNA, 19 nt, Artificial Sequence
  source: /note="Description of Artificial Sequence: Synthetic oligonucleotide"
uggcccaggaggcacuggc

SEQ ID NO: 8914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcccaggaggcacuggctt

SEQ ID NO: 8915 - RNA, 19 nt, Artificial Sequence
  source: /note="Description of Artificial Sequence: Synthetic oligonucleotide"
gccagugccuccugggcca

SEQ ID NO: 8916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagugccuccugggccatt

SEQ ID NO: 8917 - RNA, 19 nt, Artificial Sequence
  source: /note="Description of Artificial Sequence: Synthetic oligonucleotide"
agcggcagcggcggaggag

SEQ ID NO: 8918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcggcagcggcggaggagtt

SEQ ID NO: 8919 - RNA, 19 nt, Artificial Sequence
  source: /note="Description of Artificial Sequence: Synthetic oligonucleotide"
cuccuccgccgcugccgcu

SEQ ID NO: 8920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuccgccgcugccgcutt

SEQ ID NO: 8921 - RNA, 19 nt, Artificial Sequence
  source: /note="Description of Artificial Sequence: Synthetic oligonucleotide"
ggaggaggcagcgguggcc

SEQ ID NO: 8922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggaggcagcgguggcctt

SEQ ID NO: 8923 - RNA, 19 nt, Artificial Sequence
  source: /note="Description of Artificial Sequence: Synthetic oligonucleotide"
ggccaccgcugccuccucc

SEQ ID NO: 8924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaccgcugccuccucctt

SEQ ID NO: 8925 - RNA, 19 nt, Artificial Sequence
  source: /note="Description of Artificial Sequence: Synthetic oligonucleotide"
gaggaggcagcgguggccc

SEQ ID NO: 8926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggaggcagcgguggccctt

SEQ ID NO: 8927 - RNA, 19 nt, Artificial Sequence
  source: /note="Description of Artificial Sequence: Synthetic oligonucleotide"
gggccaccgcugccuccuc

SEQ ID NO: 8928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccaccgcugccuccuctt

SEQ ID NO: 8929 - RNA, 19 nt, Artificial Sequence
  source: /note="Description of Artificial Sequence: Synthetic oligonucleotide"
aggaggcagcgguggcccc

SEQ ID NO: 8930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaggcagcgguggcccctt

SEQ ID NO: 8931 - RNA, 19 nt, Artificial Sequence
  source: /note="Description of Artificial Sequence: Synthetic oligonucleotide"
ggggccaccgcugccuccu

SEQ ID NO: 8932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccaccgcugccuccutt

SEQ ID NO: 8933 - RNA, 19 nt, Artificial Sequence
  source: /note="Description of Artificial Sequence: Synthetic oligonucleotide"
ggaggcagcgguggccccg

SEQ ID NO: 8934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggcagcgguggccccgtt

SEQ ID NO: 8935 - RNA, 19 nt, Artificial Sequence
  source: /note="Description of Artificial Sequence: Synthetic oligonucleotide"
cggggccaccgcugccucc

SEQ ID NO: 8936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggccaccgcugccucctt

SEQ ID NO: 8937 - RNA, 19 nt, Artificial Sequence
  source: /note="Description of Artificial Sequence: Synthetic oligonucleotide"
aagguucuucaggacaaaa

SEQ ID NO: 8938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguucuucaggacaaaatt

SEQ ID NO: 8939 - RNA, 19 nt, Artificial Sequence
  source: /note="Description of Artificial Sequence: Synthetic oligonucleotide"
uuuuguccugaagaaccuu

SEQ ID NO: 8940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuguccugaagaaccuutt

SEQ ID NO: 8941 - RNA, 19 nt, Artificial Sequence
  source: /note="Description of Artificial Sequence: Synthetic oligonucleotide"
cuccaguggggagaagaag

SEQ ID NO: 8942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccaguggggagaagaagtt

SEQ ID NO: 8943 - RNA, 19 nt, Artificial Sequence
  source: /note="Description of Artificial Sequence: Synthetic oligonucleotide"
cuucuucuccccacuggag

SEQ ID NO: 8944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuucuccccacuggagtt

SEQ ID NO: 8945 - RNA, 19 nt, Artificial Sequence
  source: /note="Description of Artificial Sequence: Synthetic oligonucleotide"
ccaguggggagaagaagga

SEQ ID NO: 8946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaguggggagaagaaggatt

SEQ ID NO: 8947 - RNA, 19 nt, Artificial Sequence
  source: /note="Description of Artificial Sequence: Synthetic oligonucleotide"
uccuucuucuccccacugg

SEQ ID NO: 8948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuucuucuccccacuggtt

SEQ ID NO: 8949 - RNA, 19 nt, Artificial Sequence
  source: /note="Description of Artificial Sequence: Synthetic oligonucleotide"
guccucaagcucugcgauu

SEQ ID NO: 8950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccucaagcucugcgauutt

SEQ ID NO: 8951 - RNA, 19 nt, Artificial Sequence
  source: /note="Description of Artificial Sequence: Synthetic oligonucleotide"
aaucgcagagcuugaggac

SEQ ID NO: 8952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucgcagagcuugaggactt

SEQ ID NO: 8953 - RNA, 19 nt, Artificial Sequence
  source: /note="Description of Artificial Sequence: Synthetic oligonucleotide"
cccagcaggcccugcuucu

SEQ ID NO: 8954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccagcaggcccugcuucutt

SEQ ID NO: 8955 - RNA, 19 nt, Artificial Sequence
  source: /note="Description of Artificial Sequence: Synthetic oligonucleotide"
agaagcagggccugcuggg

SEQ ID NO: 8956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagcagggccugcugggtt

SEQ ID NO: 8957 - RNA, 19 nt, Artificial Sequence
  source: /note="Description of Artificial Sequence: Synthetic oligonucleotide"
ccagcaggcccugcuucuc

SEQ ID NO: 8958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcaggcccugcuucuctt

SEQ ID NO: 8959 - RNA, 19 nt, Artificial Sequence
  source: /note="Description of Artificial Sequence: Synthetic oligonucleotide"
gagaagcagggccugcugg

SEQ ID NO: 8960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaagcagggccugcuggtt

SEQ ID NO: 8961 - RNA, 19 nt, Artificial Sequence
  source: /note="Description of Artificial Sequence: Synthetic oligonucleotide"
cagcaggcccugcuucucc

SEQ ID NO: 8962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaggcccugcuucucctt

SEQ ID NO: 8963 - RNA, 19 nt, Artificial Sequence
  source: /note="Description of Artificial Sequence: Synthetic oligonucleotide"
ggagaagcagggccugcug

SEQ ID NO: 8964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaagcagggccugcugtt

SEQ ID NO: 8965 - RNA, 19 nt, Artificial Sequence
  source: /note="Description of Artificial Sequence: Synthetic oligonucleotide"
gacgggguuugggggugug

SEQ ID NO: 8966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacgggguuugggggugugtt

SEQ ID NO: 8967 - RNA, 19 nt, Artificial Sequence
  source: /note="Description of Artificial Sequence: Synthetic oligonucleotide"
cacacccccaaaccccguc

SEQ ID NO: 8968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacacccccaaaccccguctt

SEQ ID NO: 8969 - RNA, 19 nt, Artificial Sequence
  source: /note="Description of Artificial Sequence: Synthetic oligonucleotide"
guccccuccccucccccag

SEQ ID NO: 8970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccccuccccucccccagtt

SEQ ID NO: 8971 - RNA, 19 nt, Artificial Sequence
  source: /note="Description of Artificial Sequence: Synthetic oligonucleotide"
cugggggaggggaggggac

SEQ ID NO: 8972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugggggaggggaggggactt

SEQ ID NO: 8973 - RNA, 19 nt, Artificial Sequence
  source: /note="Description of Artificial Sequence: Synthetic oligonucleotide"
uccccuccccucccccagg

SEQ ID NO: 8974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccuccccucccccaggtt

SEQ ID NO: 8975 - RNA, 19 nt, Artificial Sequence
  source: /note="Description of Artificial Sequence: Synthetic oligonucleotide"
ccugggggaggggagggga

SEQ ID NO: 8976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugggggaggggaggggatt

SEQ ID NO: 8977 - RNA, 19 nt, Artificial Sequence
  source: /note="Description of Artificial Sequence: Synthetic oligonucleotide"
auuuuuucuuaaagaaaac

SEQ ID NO: 8978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuuuucuuaaagaaaactt

SEQ ID NO: 8979 - RNA, 19 nt, Artificial Sequence
  source: /note="Description of Artificial Sequence: Synthetic oligonucleotide"
guuuucuuuaagaaaaaau

SEQ ID NO: 8980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuucuuuaagaaaaaautt

SEQ ID NO: 8981 - RNA, 19 nt, Artificial Sequence
  source: /note="Description of Artificial Sequence: Synthetic oligonucleotide"
ucccucuccccauccugga

SEQ ID NO: 8982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucuccccauccuggatt

SEQ ID NO: 8983 - RNA, 19 nt, Artificial Sequence
  source: /note="Description of Artificial Sequence: Synthetic oligonucleotide"
uccaggauggggagaggga

SEQ ID NO: 8984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaggauggggagagggatt

SEQ ID NO: 8985 - RNA, 19 nt, Artificial Sequence
  source: /note="Description of Artificial Sequence: Synthetic oligonucleotide"
acuguaacauaguccgacu

SEQ ID NO: 8986 - RNA, 19 nt, Artificial Sequence
  source: /note="Description of Artificial Sequence: Synthetic oligonucleotide"
agucggacuauguuacagu

SEQ ID NO: 8987 - RNA, 19 nt, Artificial Sequence
  source: /note="Description of Artificial Sequence: Synthetic oligonucleotide"
cuguaacauaguccgacug

SEQ ID NO: 8988 - RNA, 19 nt, Artificial Sequence
  source: /note="Description of Artificial Sequence: Synthetic oligonucleotide"
cagucggacuauguuacag

SEQ ID NO: 8989 - RNA, 19 nt, Artificial Sequence
  source: /note="Description of Artificial Sequence: Synthetic oligonucleotide"
gccagacacuauagucgag

SEQ ID NO: 8990 - RNA, 19 nt, Artificial Sequence
  source: /note="Description of Artificial Sequence: Synthetic oligonucleotide"
cucgacuauagugucuggc

SEQ ID NO: 8991 - RNA, 19 nt, Artificial Sequence
  source: /note="Description of Artificial Sequence: Synthetic oligonucleotide"
aacauaguccgacugcggu

SEQ ID NO: 8992 - RNA, 19 nt, Artificial Sequence
  source: /note="Description of Artificial Sequence: Synthetic oligonucleotide"
accgcagucggacuauguu

SEQ ID NO: 8993 - RNA, 19 nt, Artificial Sequence
  source: /note="Description of Artificial Sequence: Synthetic oligonucleotide"
gaccacuguaacauagucc

SEQ ID NO: 8994 - RNA, 19 nt, Artificial Sequence
  source: /note="Description of Artificial Sequence: Synthetic oligonucleotide"
ggacuauguuacagugguc

SEQ ID NO: 8995 - RNA, 19 nt, Artificial Sequence
  source: /note="Description of Artificial Sequence: Synthetic oligonucleotide"
uaacauaguccgacugcgg

SEQ ID NO: 8996 - RNA, 19 nt, Artificial Sequence
  source: /note="Description of Artificial Sequence: Synthetic oligonucleotide"
ccgcagucggacuauguua

SEQ ID NO: 8997 - RNA, 19 nt, Artificial Sequence
  source: /note="Description of Artificial Sequence: Synthetic oligonucleotide"
cauaguccgacugcgguau

SEQ ID NO: 8998 - RNA, 19 nt, Artificial Sequence
  source: /note="Description of Artificial Sequence: Synthetic oligonucleotide"
auaccgcagucggacuaug

SEQ ID NO: 8999 - RNA, 19 nt, Artificial Sequence
  source: /note="Description of Artificial Sequence: Synthetic oligonucleotide"
agacacuauagucgagcca

SEQ ID NO: 9000 - RNA, 19 nt, Artificial Sequence
  source: /note="Description of Artificial Sequence: Synthetic oligonucleotide"
uggcucgacuauagugucu

SEQ ID NO: 9001 - RNA, 19 nt, Artificial Sequence
  source: /note="Description of Artificial Sequence: Synthetic oligonucleotide"
acacuauagucgagccaag

SEQ ID NO: 9002 - RNA, 19 nt, Artificial Sequence
  source: /note="Description of Artificial Sequence: Synthetic oligonucleotide"
cuuggcucgacuauagugu

SEQ ID NO: 9003 - RNA, 19 nt, Artificial Sequence
  source: /note="Description of Artificial Sequence: Synthetic oligonucleotide"
cauauaucuguucucggua

SEQ ID NO: 9004 - RNA, 19 nt, Artificial Sequence
  source: /note="Description of Artificial Sequence: Synthetic oligonucleotide"
uaccgagaacagauauaug

SEQ ID NO: 9005 - RNA, 19 nt, Artificial Sequence
  source: /note="Description of Artificial Sequence: Synthetic oligonucleotide"
uacaggacaagcgauuuaa

SEQ ID NO: 9006 - RNA, 19 nt, Artificial Sequence
  source: /note="Description of Artificial Sequence: Synthetic oligonucleotide"
uuaaaucgcuuguccugua

SEQ ID NO: 9007 - RNA, 19 nt, Artificial Sequence
  source: /note="Description of Artificial Sequence: Synthetic oligonucleotide"
cgguauuucuucuacucga

SEQ ID NO: 9008 - RNA, 19 nt, Artificial Sequence
  source: /note="Description of Artificial Sequence: Synthetic oligonucleotide"
ucgaguagaagaaauaccg

SEQ ID NO: 9009 - RNA, 19 nt, Artificial Sequence
  source: /note="Description of Artificial Sequence: Synthetic oligonucleotide"
uucagaagucuagccuaua

SEQ ID NO: 9010 - RNA, 19 nt, Artificial Sequence
  source: /note="Description of Artificial Sequence: Synthetic oligonucleotide"
uauaggcuagacuucugaa

SEQ ID NO: 9011 - RNA, 19 nt, Artificial Sequence
  source: /note="Description of Artificial Sequence: Synthetic oligonucleotide"
gguauuucuucuacucgag

SEQ ID NO: 9012 - RNA, 19 nt, Artificial Sequence
  source: /note="Description of Artificial Sequence: Synthetic oligonucleotide"
cucgaguagaagaaauacc

SEQ ID NO: 9013 - RNA, 19 nt, Artificial Sequence
  source: /note="Description of Artificial Sequence: Synthetic oligonucleotide"
caccuaccgcccggcuaac

SEQ ID NO: 9014 - RNA, 19 nt, Artificial Sequence
  source: /note="Description of Artificial Sequence: Synthetic oligonucleotide"
guuagccgggcgguaggug

SEQ ID NO: 9015 - RNA, 19 nt, Artificial Sequence
  source: /note="Description of Artificial Sequence: Synthetic oligonucleotide"
aagcgauuuaagaaccgag

SEQ ID NO: 9016 - RNA, 19 nt, Artificial Sequence
  source: /note="Description of Artificial Sequence: Synthetic oligonucleotide"
cucgguucuuaaaucgcuu

SEQ ID NO: 9017 - RNA, 19 nt, Artificial Sequence
  source: /note="Description of Artificial Sequence: Synthetic oligonucleotide"
uguaacauaguccgacugc

SEQ ID NO: 9018 - RNA, 19 nt, Artificial Sequence
  source: /note="Description of Artificial Sequence: Synthetic oligonucleotide"
gcagucggacuauguuaca

SEQ ID NO: 9019 - RNA, 19 nt, Artificial Sequence
  source: /note="Description of Artificial Sequence: Synthetic oligonucleotide"
ugauuacacguccaguaua

SEQ ID NO: 9020 - RNA, 19 nt, Artificial Sequence
  source: /note="Description of Artificial Sequence: Synthetic oligonucleotide"
uauacuggacguguaauca

SEQ ID NO: 9021 - RNA, 19 nt, Artificial Sequence
  source: /note="Description of Artificial Sequence: Synthetic oligonucleotide"
acguccaguauagauguau

SEQ ID NO: 9022 - RNA, 19 nt, Artificial Sequence
  source: /note="Description of Artificial Sequence: Synthetic oligonucleotide"
auacaucuauacuggacgu

SEQ ID NO: 9023 - RNA, 19 nt, Artificial Sequence
  source: /note="Description of Artificial Sequence: Synthetic oligonucleotide"
gacacgaaagugauuggaa

SEQ ID NO: 9024 - RNA, 19 nt, Artificial Sequence
  source: /note="Description of Artificial Sequence: Synthetic oligonucleotide"
uuccaaucacuuucguguc

SEQ ID NO: 9025 - RNA, 19 nt, Artificial Sequence
  source: /note="Description of Artificial Sequence: Synthetic oligonucleotide"
guaacauaguccgacugcg

SEQ ID NO: 9026 - RNA, 19 nt, Artificial Sequence
  source: /note="Description of Artificial Sequence: Synthetic oligonucleotide"
cgcagucggacuauguuac

SEQ ID NO: 9027 - RNA, 19 nt, Artificial Sequence
  source: /note="Description of Artificial Sequence: Synthetic oligonucleotide"
uaguccgacugcgguauuu

SEQ ID NO: 9028 - RNA, 19 nt, Artificial Sequence
  source: /note="Description of Artificial Sequence: Synthetic oligonucleotide"
aaauaccgcagucggacua

SEQ ID NO: 9029 - RNA, 19 nt, Artificial Sequence
  source: /note="Description of Artificial Sequence: Synthetic oligonucleotide"
uucuacucgaguggugaga

SEQ ID NO: 9030 - RNA, 19 nt, Artificial Sequence
  source: /note="Description of Artificial Sequence: Synthetic oligonucleotide"
ucucaccacucgaguagaa

SEQ ID NO: 9031 - RNA, 19 nt, Artificial Sequence
  source: /note="Description of Artificial Sequence: Synthetic oligonucleotide"
ucagaagucuagccuauau

SEQ ID NO: 9032 - RNA, 19 nt, Artificial Sequence
  source: /note="Description of Artificial Sequence: Synthetic oligonucleotide"
auauaggcuagacuucuga

SEQ ID NO: 9033 - RNA, 19 nt, Artificial Sequence
  source: /note="Description of Artificial Sequence: Synthetic oligonucleotide"
agaagucuagccuauaucc

SEQ ID NO: 9034 - RNA, 19 nt, Artificial Sequence
  source: /note="Description of Artificial Sequence: Synthetic oligonucleotide"
ggauauaggcuagacuucu

SEQ ID NO: 9035 - RNA, 19 nt, Artificial Sequence
  source: /note="Description of Artificial Sequence: Synthetic oligonucleotide"
cugauuacacguccaguau

SEQ ID NO: 9036 - RNA, 19 nt, Artificial Sequence
  source: /note="Description of Artificial Sequence: Synthetic oligonucleotide"
auacuggacguguaaucag

SEQ ID NO: 9037 - RNA, 19 nt, Artificial Sequence
  source: /note="Description of Artificial Sequence: Synthetic oligonucleotide"
acaggacaagcgauuuaag

SEQ ID NO: 9038 - RNA, 19 nt, Artificial Sequence
  source: /note="Description of Artificial Sequence: Synthetic oligonucleotide"
cuuaaaucgcuuguccugu

SEQ ID NO: 9039 - RNA, 19 nt, Artificial Sequence
  source: /note="Description of Artificial Sequence: Synthetic oligonucleotide"
gacuauguuccggagacag

SEQ ID NO: 9040 - RNA, 19 nt, Artificial Sequence
  source: /note="Description of Artificial Sequence: Synthetic oligonucleotide"
cugucuccggaacauaguc

SEQ ID NO: 9041 - RNA, 19 nt, Artificial Sequence
  source: /note="Description of Artificial Sequence: Synthetic oligonucleotide"
guucagaagucuagccuau

SEQ ID NO: 9042 - RNA, 19 nt, Artificial Sequence
  source: /note="Description of Artificial Sequence: Synthetic oligonucleotide"
auaggcuagacuucugaac

SEQ ID NO: 9043 - RNA, 19 nt, Artificial Sequence
  source: /note="Description of Artificial Sequence: Synthetic oligonucleotide"
uacacaccuaccgcccggc

SEQ ID NO: 9044 - RNA, 19 nt, Artificial Sequence
  source: /note="Description of Artificial Sequence: Synthetic oligonucleotide"
gccgggcgguaggugugua

SEQ ID NO: 9045 - RNA, 19 nt, Artificial Sequence
  source: /note="Description of Artificial Sequence: Synthetic oligonucleotide"
acaggaagucaguuauaca

SEQ ID NO: 9046 - RNA, 19 nt, Artificial Sequence
  source: /note="Description of Artificial Sequence: Synthetic oligonucleotide"
uguauaacugacuuccugu

SEQ ID NO: 9047 - RNA, 19 nt, Artificial Sequence
  source: /note="Description of Artificial Sequence: Synthetic oligonucleotide"
ccacuguaacauaguccga

SEQ ID NO: 9048 - RNA, 19 nt, Artificial Sequence
  source: /note="Description of Artificial Sequence: Synthetic oligonucleotide"
ucggacuauguuacagugg

SEQ ID NO: 9049 - RNA, 19 nt, Artificial Sequence
  source: /note="Description of Artificial Sequence: Synthetic oligonucleotide"
uggaguacacaccuaccgc

SEQ ID NO: 9050 - RNA, 19 nt, Artificial Sequence
  source: /note="Description of Artificial Sequence: Synthetic oligonucleotide"
gcgguagguguguacucca

SEQ ID NO: 9051 - RNA, 19 nt, Artificial Sequence
  source: /note="Description of Artificial Sequence: Synthetic oligonucleotide"
cuauguuccggagacagug

SEQ ID NO: 9052 - RNA, 19 nt, Artificial Sequence
  source: /note="Description of Artificial Sequence: Synthetic oligonucleotide"
cacugucuccggaacauag

SEQ ID NO: 9053 - RNA, 19 nt, Artificial Sequence
  source: /note="Description of Artificial Sequence: Synthetic oligonucleotide"
cuguucucgguacuacagg

SEQ ID NO: 9054 - RNA, 19 nt, Artificial Sequence
  source: /note="Description of Artificial Sequence: Synthetic oligonucleotide"
ccuguaguaccgagaacag

SEQ ID NO: 9055 - RNA, 19 nt, Artificial Sequence
  source: /note="Description of Artificial Sequence: Synthetic oligonucleotide"
uguucucgguacuacaggg

SEQ ID NO: 9056 - RNA, 19 nt, Artificial Sequence
  source: /note="Description of Artificial Sequence: Synthetic oligonucleotide"
cccuguaguaccgagaaca

SEQ ID NO: 9057 - RNA, 19 nt, Artificial Sequence
  source: /note="Description of Artificial Sequence: Synthetic oligonucleotide"
ccgcccggcuaacaccacu

SEQ ID NO: 9058 - RNA, 19 nt, Artificial Sequence
  source: /note="Description of Artificial Sequence: Synthetic oligonucleotide"
agugguguuagccgggcgg

SEQ ID NO: 9059 - RNA, 19 nt, Artificial Sequence
  source: /note="Description of Artificial Sequence: Synthetic oligonucleotide"
cuaccgcccggcuaacacc

SEQ ID NO: 9060 - RNA, 19 nt, Artificial Sequence
  source: /note="Description of Artificial Sequence: Synthetic oligonucleotide"
gguguuagccgggcgguag

SEQ ID NO: 9061 - RNA, 19 nt, Artificial Sequence
  source: /note="Description of Artificial Sequence: Synthetic oligonucleotide"
auuacacguccaguauaga

SEQ ID NO: 9062 - RNA, 19 nt, Artificial Sequence
  source: /note="Description of Artificial Sequence: Synthetic oligonucleotide"
ucuauacuggacguguaau

SEQ ID NO: 9063 - RNA, 19 nt, Artificial Sequence
  source: /note="Description of Artificial Sequence: Synthetic oligonucleotide"
cuacucgaguggugagaag

SEQ ID NO: 9064 - RNA, 19 nt, Artificial Sequence
  source: /note="Description of Artificial Sequence: Synthetic oligonucleotide"
cuucucaccacucgaguag

SEQ ID NO: 9065 - RNA, 19 nt, Artificial Sequence
  source: /note="Description of Artificial Sequence: Synthetic oligonucleotide"
gcuggacuauguuccggag

SEQ ID NO: 9066 - RNA, 19 nt, Artificial Sequence
  source: /note="Description of Artificial Sequence: Synthetic oligonucleotide"
cuccggaacauaguccagc

SEQ ID NO: 9067 - RNA, 19 nt, Artificial Sequence
  source: /note="Description of Artificial Sequence: Synthetic oligonucleotide"
cuggacuauguuccggaga

SEQ ID NO: 9068 - RNA, 19 nt, Artificial Sequence
  source: /note="Description of Artificial Sequence: Synthetic oligonucleotide"
ucuccggaacauaguccag

SEQ ID NO: 9069 - RNA, 19 nt, Artificial Sequence
  source: /note="Description of Artificial Sequence: Synthetic oligonucleotide"
ucgccagacacuauagucg

SEQ ID NO: 9070 - RNA, 19 nt, Artificial Sequence
  source: /note="Description of Artificial Sequence: Synthetic oligonucleotide"
cgacuauagugucuggcga

SEQ ID NO: 9071 - RNA, 19 nt, Artificial Sequence
  source: /note="Description of Artificial Sequence: Synthetic oligonucleotide"
cacuauagucgagccaagc

SEQ ID NO: 9072 - RNA, 19 nt, Artificial Sequence
  source: /note="Description of Artificial Sequence: Synthetic oligonucleotide"
gcuuggcucgacuauagug

SEQ ID NO: 9073 - RNA, 19 nt, Artificial Sequence
  source: /note="Description of Artificial Sequence: Synthetic oligonucleotide"
gauuacacguccaguauag

SEQ ID NO: 9074 - RNA, 19 nt, Artificial Sequence
  source: /note="Description of Artificial Sequence: Synthetic oligonucleotide"
cuauacuggacguguaauc

SEQ ID NO: 9075 - RNA, 19 nt, Artificial Sequence
  source: /note="Description of Artificial Sequence: Synthetic oligonucleotide"
uuacacguccaguauagau

SEQ ID NO: 9076 - RNA, 19 nt, Artificial Sequence
  source: /note="Description of Artificial Sequence: Synthetic oligonucleotide"
aucuauacuggacguguaa

SEQ ID NO: 9077 - RNA, 19 nt, Artificial Sequence
  source: /note="Description of Artificial Sequence: Synthetic oligonucleotide"
ccggccccgaacuccacca

SEQ ID NO: 9078 - RNA, 19 nt, Artificial Sequence
  source: /note="Description of Artificial Sequence: Synthetic oligonucleotide"
ugguggaguucggggccgg

SEQ ID NO: 9079 - RNA, 19 nt, Artificial Sequence
  source: /note="Description of Artificial Sequence: Synthetic oligonucleotide"
acacaccuaccgcccggcu

SEQ ID NO: 9080 - RNA, 19 nt, Artificial Sequence
  source: /note="Description of Artificial Sequence: Synthetic oligonucleotide"
agccgggcgguaggugugu

SEQ ID NO: 9081 - RNA, 19 nt, Artificial Sequence
  source: /note="Description of Artificial Sequence: Synthetic oligonucleotide"
cacaccuaccgcccggcua

SEQ ID NO: 9082 - RNA, 19 nt, Artificial Sequence
  source: /note="Description of Artificial Sequence: Synthetic oligonucleotide"
uagccgggcgguaggugug

SEQ ID NO: 9083 - RNA, 19 nt, Artificial Sequence
  source: /note="Description of Artificial Sequence: Synthetic oligonucleotide"
accuaccgcccggcuaaca

SEQ ID NO: 9084 - RNA, 19 nt, Artificial Sequence
  source: /note="Description of Artificial Sequence: Synthetic oligonucleotide"
uguuagccgggcgguaggu

SEQ ID NO: 9085 - RNA, 19 nt, Artificial Sequence
  source: /note="Description of Artificial Sequence: Synthetic oligonucleotide"
ccuaccgcccggcuaacac

SEQ ID NO: 9086 - RNA, 19 nt, Artificial Sequence
  source: /note="Description of Artificial Sequence: Synthetic oligonucleotide"
guguuagccgggcgguagg

SEQ ID NO: 9087 - RNA, 19 nt, Artificial Sequence
  source: /note="Description of Artificial Sequence: Synthetic oligonucleotide"
caugucggggcgaccgaga

SEQ ID NO: 9088 - RNA, 19 nt, Artificial Sequence
  source: /note="Description of Artificial Sequence: Synthetic oligonucleotide"
ucucggucgccccgacaug

SEQ ID NO: 9089 - RNA, 19 nt, Artificial Sequence
  source: /note="Description of Artificial Sequence: Synthetic oligonucleotide"
gucggggcgaccgagaacc

SEQ ID NO: 9090 - RNA, 19 nt, Artificial Sequence
  source: /note="Description of Artificial Sequence: Synthetic oligonucleotide"
gguucucggucgccccgac

SEQ ID NO: 9091 - RNA, 19 nt, Artificial Sequence
  source: /note="Description of Artificial Sequence: Synthetic oligonucleotide"
ggcgaccgagaaccaccuc

SEQ ID NO: 9092 - RNA, 19 nt, Artificial Sequence
  source: /note="Description of Artificial Sequence: Synthetic oligonucleotide"
gaggugguucucggucgcc

SEQ ID NO: 9093 - RNA, 19 nt, Artificial Sequence
  source: /note="Description of Artificial Sequence: Synthetic oligonucleotide"
gacaagcgauuuaagaacc

SEQ ID NO: 9094 - RNA, 19 nt, Artificial Sequence
  source: /note="Description of Artificial Sequence: Synthetic oligonucleotide"
gguucuuaaaucgcuuguc

SEQ ID NO: 9095 - RNA, 19 nt, Artificial Sequence
  source: /note="Description of Artificial Sequence: Synthetic oligonucleotide"
agcgauuuaagaaccgaga

SEQ ID NO: 9096 - RNA, 19 nt, Artificial Sequence
  source: /note="Description of Artificial Sequence: Synthetic oligonucleotide"
ucucgguucuuaaaucgcu

SEQ ID NO: 9097 - RNA, 19 nt, Artificial Sequence
  source: /note="Description of Artificial Sequence: Synthetic oligonucleotide"
gcgauuuaagaaccgagag

SEQ ID NO: 9098 - RNA, 19 nt, Artificial Sequence
  source: /note="Description of Artificial Sequence: Synthetic oligonucleotide"
cucucgguucuuaaaucgc

SEQ ID NO: 9099 - RNA, 19 nt, Artificial Sequence
  source: /note="Description of Artificial Sequence: Synthetic oligonucleotide"
cgauuuaagaaccgagagc

SEQ ID NO: 9100 - RNA, 19 nt, Artificial Sequence
  source: /note="Description of Artificial Sequence: Synthetic oligonucleotide"
gcucucgguucuuaaaucg

SEQ ID NO: 9101 - RNA, 19 nt, Artificial Sequence
  source: /note="Description of Artificial Sequence: Synthetic oligonucleotide"
aagcuagaccacuguaaca

SEQ ID NO: 9102 - RNA, 19 nt, Artificial Sequence
  source: /note="Description of Artificial Sequence: Synthetic oligonucleotide"
uguuacaguggucuagcuu

SEQ ID NO: 9103 - RNA, 19 nt, Artificial Sequence
  source: /note="Description of Artificial Sequence: Synthetic oligonucleotide"
uagaccacuguaacauagu

SEQ ID NO: 9104 - RNA, 19 nt, Artificial Sequence
  source: /note="Description of Artificial Sequence: Synthetic oligonucleotide"
acuauguuacaguggucua

SEQ ID NO: 9105 - RNA, 19 nt, Artificial Sequence
  source: /note="Description of Artificial Sequence: Synthetic oligonucleotide"
auaguccgacugcgguauu

SEQ ID NO: 9106 - RNA, 19 nt, Artificial Sequence
  source: /note="Description of Artificial Sequence: Synthetic oligonucleotide"
aauaccgcagucggacuau

SEQ ID NO: 9107 - RNA, 19 nt, Artificial Sequence
  source: /note="Description of Artificial Sequence: Synthetic oligonucleotide"
aguccgacugcgguauuuc

SEQ ID NO: 9108 - RNA, 19 nt, Artificial Sequence
  source: /note="Description of Artificial Sequence: Synthetic oligonucleotide"
gaaauaccgcagucggacu

SEQ ID NO: 9109 - RNA, 19 nt, Artificial Sequence
  source: /note="Description of Artificial Sequence: Synthetic oligonucleotide"
guccgacugcgguauuucu

SEQ ID NO: 9110 - RNA, 19 nt, Artificial Sequence
  source: /note="Description of Artificial Sequence: Synthetic oligonucleotide"
agaaauaccgcagucggac

SEQ ID NO: 9111 - RNA, 19 nt, Artificial Sequence
  source: /note="Description of Artificial Sequence: Synthetic oligonucleotide"
ccgacugcgguauuucuuc

SEQ ID NO: 9112 - RNA, 19 nt, Artificial Sequence
  source: /note="Description of Artificial Sequence: Synthetic oligonucleotide"
gaagaaauaccgcagucgg

SEQ ID NO: 9113 - RNA, 19 nt, Artificial Sequence
  source: /note="Description of Artificial Sequence: Synthetic oligonucleotide"
cuucuacucgaguggugag

SEQ ID NO: 9114 - RNA, 19 nt, Artificial Sequence
  source: /note="Description of Artificial Sequence: Synthetic oligonucleotide"
cucaccacucgaguagaag

SEQ ID NO: 9115 - RNA, 19 nt, Artificial Sequence
  source: /note="Description of Artificial Sequence: Synthetic oligonucleotide"
gaugaggucuaccuuaacc

SEQ ID NO: 9116 - RNA, 19 nt, Artificial Sequence
  source: /note="Description of Artificial Sequence: Synthetic oligonucleotide"
gguuaagguagaccucauc

SEQ ID NO: 9117 - RNA, 19 nt, Artificial Sequence
  source: /note="Description of Artificial Sequence: Synthetic oligonucleotide"
gugcuggacuauguuccgg

SEQ ID NO: 9118 - RNA, 19 nt, Artificial Sequence
  source: /note="Description of Artificial Sequence: Synthetic oligonucleotide"
ccggaacauaguccagcac

SEQ ID NO: 9119 - RNA, 19 nt, Artificial Sequence
  source: /note="Description of Artificial Sequence: Synthetic oligonucleotide"
uguuccggagacaguguac

SEQ ID NO: 9120 - RNA, 19 nt, Artificial Sequence
  source: /note="Description of Artificial Sequence: Synthetic oligonucleotide"
guacacugucuccggaaca

SEQ ID NO: 9121 - RNA, 19 nt, Artificial Sequence
  source: /note="Description of Artificial Sequence: Synthetic oligonucleotide"
ccagacacuauagucgagc

SEQ ID NO: 9122 - RNA, 19 nt, Artificial Sequence
  source: /note="Description of Artificial Sequence: Synthetic oligonucleotide"
gcucgacuauagugucugg

SEQ ID NO: 9123 - RNA, 19 nt, Artificial Sequence
  source: /note="Description of Artificial Sequence: Synthetic oligonucleotide"
acuauagucgagccaagca

SEQ ID NO: 9124 - RNA, 19 nt, Artificial Sequence
  source: /note="Description of Artificial Sequence: Synthetic oligonucleotide"
ugcuuggcucgacuauagu

SEQ ID NO: 9125 - RNA, 19 nt, Artificial Sequence
  source: /note="Description of Artificial Sequence: Synthetic oligonucleotide"
cuauagucgagccaagcag

SEQ ID NO: 9126 - RNA, 19 nt, Artificial Sequence
  source: /note="Description of Artificial Sequence: Synthetic oligonucleotide"
cugcuuggcucgacuauag

SEQ ID NO: 9127 - RNA, 19 nt, Artificial Sequence
  source: /note="Description of Artificial Sequence: Synthetic oligonucleotide"
cagaagucuagccuauauc

SEQ ID NO: 9128 - RNA, 19 nt, Artificial Sequence
  source: /note="Description of Artificial Sequence: Synthetic oligonucleotide"
gauauaggcuagacuucug

SEQ ID NO: 9129 - RNA, 19 nt, Artificial Sequence
  source: /note="Description of Artificial Sequence: Synthetic oligonucleotide"
guuggauccugauacagcu

SEQ ID NO: 9130 - RNA, 19 nt, Artificial Sequence
  source: /note="Description of Artificial Sequence: Synthetic oligonucleotide"
agcuguaucaggauccaac

SEQ ID NO: 9131 - RNA, 19 nt, Artificial Sequence
  source: /note="Description of Artificial Sequence: Synthetic oligonucleotide"
uucucgguacuacagggca

SEQ ID NO: 9132 - RNA, 19 nt, Artificial Sequence
  source: /note="Description of Artificial Sequence: Synthetic oligonucleotide"
ugcccuguaguaccgagaa

SEQ ID NO: 9133 - RNA, 19 nt, Artificial Sequence
  source: /note="Description of Artificial Sequence: Synthetic oligonucleotide"
cuacagggcaccagaguug

SEQ ID NO: 9134 - RNA, 19 nt, Artificial Sequence
  source: /note="Description of Artificial Sequence: Synthetic oligonucleotide"
caacucuggugcccuguag

SEQ ID NO: 9135 - RNA, 19 nt, Artificial Sequence
  source: /note="Description of Artificial Sequence: Synthetic oligonucleotide"
cacugauuacacguccagu

SEQ ID NO: 9136 - RNA, 19 nt, Artificial Sequence
  source: /note="Description of Artificial Sequence: Synthetic oligonucleotide"
acuggacguguaaucagug

SEQ ID NO: 9137 - RNA, 19 nt, Artificial Sequence
  source: /note="Description of Artificial Sequence: Synthetic oligonucleotide"
acugauuacacguccagua

SEQ ID NO: 9138 - RNA, 19 nt, Artificial Sequence
  source: /note="Description of Artificial Sequence: Synthetic oligonucleotide"
uacuggacguguaaucagu

SEQ ID NO: 9139 - RNA, 19 nt, Artificial Sequence
  source: /note="Description of Artificial Sequence: Synthetic oligonucleotide"
acacguccaguauagaugu

SEQ ID NO: 9140 - RNA, 19 nt, Artificial Sequence
  source: /note="Description of Artificial Sequence: Synthetic oligonucleotide"
acaucuauacuggacgugu

SEQ ID NO: 9141 - RNA, 19 nt, Artificial Sequence
  source: /note="Description of Artificial Sequence: Synthetic oligonucleotide"
cacguccaguauagaugua

SEQ ID NO: 9142 - RNA, 19 nt, Artificial Sequence
  source: /note="Description of Artificial Sequence: Synthetic oligonucleotide"
uacaucuauacuggacgug

SEQ ID NO: 9143 - RNA, 19 nt, Artificial Sequence
  source: /note="Description of Artificial Sequence: Synthetic oligonucleotide"
uugcuaggacaaccaauau

SEQ ID NO: 9144 - RNA, 19 nt, Artificial Sequence
  source: /note="Description of Artificial Sequence: Synthetic oligonucleotide"
auauugguuguccuagcaa

SEQ ID NO: 9145 - RNA, 19 nt, Artificial Sequence
  source: /note="Description of Artificial Sequence: Synthetic oligonucleotide"
ugcuaggacaaccaauauu

SEQ ID NO: 9146 - RNA, 19 nt, Artificial Sequence
  source: /note="Description of Artificial Sequence: Synthetic oligonucleotide"
aauauugguuguccuagca

SEQ ID NO: 9147 - RNA, 19 nt, Artificial Sequence
  source: /note="Description of Artificial Sequence: Synthetic oligonucleotide"
cuaggacaaccaauauuuc

SEQ ID NO: 9148 - RNA, 19 nt, Artificial Sequence
  source: /note="Description of Artificial Sequence: Synthetic oligonucleotide"
gaaauauugguuguccuag

SEQ ID NO: 9149 - RNA, 19 nt, Artificial Sequence
  source: /note="Description of Artificial Sequence: Synthetic oligonucleotide"
agugguguggaucaguugg

SEQ ID NO: 9150 - RNA, 19 nt, Artificial Sequence
  source: /note="Description of Artificial Sequence: Synthetic oligonucleotide"
ccaacugauccacaccacu

SEQ ID NO: 9151 - RNA, 19 nt, Artificial Sequence
  source: /note="Description of Artificial Sequence: Synthetic oligonucleotide"
ggaguacacaccuaccgcc

SEQ ID NO: 9152 - RNA, 19 nt, Artificial Sequence
  source: /note="Description of Artificial Sequence: Synthetic oligonucleotide"
ggcgguagguguguacucc

SEQ ID NO: 9153 - RNA, 19 nt, Artificial Sequence
  source: /note="Description of Artificial Sequence: Synthetic oligonucleotide"
guacacaccuaccgcccgg

SEQ ID NO: 9154 - RNA, 19 nt, Artificial Sequence
  source: /note="Description of Artificial Sequence: Synthetic oligonucleotide"
ccgggcgguagguguguac

SEQ ID NO: 9155 - RNA, 19 nt, Artificial Sequence
  source: /note="Description of Artificial Sequence: Synthetic oligonucleotide"
accgcccggcuaacaccac

SEQ ID NO: 9156 - RNA, 19 nt, Artificial Sequence
  source: /note="Description of Artificial Sequence: Synthetic oligonucleotide"
gugguguuagccgggcggu

SEQ ID NO: 9157 - RNA, 19 nt, Artificial Sequence
  source: /note="Description of Artificial Sequence: Synthetic oligonucleotide"
ccggcuaacaccacuggaa

SEQ ID NO: 9158 - RNA, 19 nt, Artificial Sequence
  source: /note="Description of Artificial Sequence: Synthetic oligonucleotide"
uuccagugguguuagccgg

SEQ ID NO: 9159 - RNA, 19 nt, Artificial Sequence
  source: /note="Description of Artificial Sequence: Synthetic oligonucleotide"
cagacacgaaagugauugg

SEQ ID NO: 9160 - RNA, 19 nt, Artificial Sequence
  source: /note="Description of Artificial Sequence: Synthetic oligonucleotide"
ccaaucacuuucgugucug

SEQ ID NO: 9161 - RNA, 19 nt, Artificial Sequence
  source: /note="Description of Artificial Sequence: Synthetic oligonucleotide"
aucauuuggugugguauau

SEQ ID NO: 9162 - RNA, 19 nt, Artificial Sequence
  source: /note="Description of Artificial Sequence: Synthetic oligonucleotide"
auauaccacaccaaaugau

SEQ ID NO: 9163 - RNA, 19 nt, Artificial Sequence
  source: /note="Description of Artificial Sequence: Synthetic oligonucleotide"
cauuuggugugguauauca

SEQ ID NO: 9164 - RNA, 19 nt, Artificial Sequence
  source: /note="Description of Artificial Sequence: Synthetic oligonucleotide"
ugauauaccacaccaaaug

SEQ ID NO: 9165 - RNA, 19 nt, Artificial Sequence
  source: /note="Description of Artificial Sequence: Synthetic oligonucleotide"
agcuagaccacuguaacau

SEQ ID NO: 9166 - RNA, 19 nt, Artificial Sequence
  source: /note="Description of Artificial Sequence: Synthetic oligonucleotide"
auguuacaguggucuagcu

SEQ ID NO: 9167 - RNA, 19 nt, Artificial Sequence
  source: /note="Description of Artificial Sequence: Synthetic oligonucleotide"
acauaguccgacugcggua

SEQ ID NO: 9168 - RNA, 19 nt, Artificial Sequence
  source: /note="Description of Artificial Sequence: Synthetic oligonucleotide"
uaccgcagucggacuaugu

SEQ ID NO: 9169 - RNA, 19 nt, Artificial Sequence
  source: /note="Description of Artificial Sequence: Synthetic oligonucleotide"
ucuacucgaguggugagaa

SEQ ID NO: 9170 - RNA, 19 nt, Artificial Sequence
  source: /note="Description of Artificial Sequence: Synthetic oligonucleotide"
uucucaccacucgaguaga

SEQ ID NO: 9171 - RNA, 19 nt, Artificial Sequence
  source: /note="Description of Artificial Sequence: Synthetic oligonucleotide"
ucaaguuguauauguauca

SEQ ID NO: 9172 - RNA, 19 nt, Artificial Sequence
  source: /note="Description of Artificial Sequence: Synthetic oligonucleotide"
ugauacauauacaacuuga

SEQ ID NO: 9173 - RNA, 19 nt, Artificial Sequence
  source: /note="Description of Artificial Sequence: Synthetic oligonucleotide"
guaucagcuguucagaagu

SEQ ID NO: 9174 - RNA, 19 nt, Artificial Sequence
  source: /note="Description of Artificial Sequence: Synthetic oligonucleotide"
acuucugaacagcugauac

SEQ ID NO: 9175 - RNA, 19 nt, Artificial Sequence
  source: /note="Description of Artificial Sequence: Synthetic oligonucleotide"
aucugccaucgagacauua

SEQ ID NO: 9176 - RNA, 19 nt, Artificial Sequence
  source: /note="Description of Artificial Sequence: Synthetic oligonucleotide"
uaaugucucgauggcagau

SEQ ID NO: 9177 - RNA, 19 nt, Artificial Sequence
  source: /note="Description of Artificial Sequence: Synthetic oligonucleotide"
ggagagcccaauguuucau

SEQ ID NO: 9178 - RNA, 19 nt, Artificial Sequence
  source: /note="Description of Artificial Sequence: Synthetic oligonucleotide"
augaaacauugggcucucc

SEQ ID NO: 9179 - RNA, 19 nt, Artificial Sequence
  source: /note="Description of Artificial Sequence: Synthetic oligonucleotide"
ucauauaucuguucucggu

SEQ ID NO: 9180 - RNA, 19 nt, Artificial Sequence
  source: /note="Description of Artificial Sequence: Synthetic oligonucleotide"
accgagaacagauauauga

SEQ ID NO: 9181 - RNA, 19 nt, Artificial Sequence
  source: /note="Description of Artificial Sequence: Synthetic oligonucleotide"
cucgguacuacagggcacc

SEQ ID NO: 9182 - RNA, 19 nt, Artificial Sequence
  source: /note="Description of Artificial Sequence: Synthetic oligonucleotide"
ggugcccuguaguaccgag

SEQ ID NO: 9183 - RNA, 19 nt, Artificial Sequence
  source: /note="Description of Artificial Sequence: Synthetic oligonucleotide"
cagugguguggaucaguug

SEQ ID NO: 9184 - RNA, 19 nt, Artificial Sequence
  source: /note="Description of Artificial Sequence: Synthetic oligonucleotide"
caacugauccacaccacug

SEQ ID NO: 9185 - RNA, 19 nt, Artificial Sequence
  source: /note="Description of Artificial Sequence: Synthetic oligonucleotide"
acaagggagcaaauuagag

SEQ ID NO: 9186 - RNA, 19 nt, Artificial Sequence
  source: /note="Description of Artificial Sequence: Synthetic oligonucleotide"
cucuaauuugcucccuugu

SEQ ID NO: 9187 - RNA, 19 nt, Artificial Sequence
  source: /note="Description of Artificial Sequence: Synthetic oligonucleotide"
ggacaaaggucuuccggcc

SEQ ID NO: 9188 - RNA, 19 nt, Artificial Sequence
  source: /note="Description of Artificial Sequence: Synthetic oligonucleotide"
ggccggaagaccuuugucc

SEQ ID NO: 9189 - RNA, 19 nt, Artificial Sequence
  source: /note="Description of Artificial Sequence: Synthetic oligonucleotide"
ucggggcgaccgagaacca

SEQ ID NO: 9190 - RNA, 19 nt, Artificial Sequence
  source: /note="Description of Artificial Sequence: Synthetic oligonucleotide"
ugguucucggucgccccga

SEQ ID NO: 9191 - RNA, 19 nt, Artificial Sequence
  source: /note="Description of Artificial Sequence: Synthetic oligonucleotide"
gggcgaccgagaaccaccu

SEQ ID NO: 9192 - RNA, 19 nt, Artificial Sequence
  source: /note="Description of Artificial Sequence: Synthetic oligonucleotide"
aggugguucucggucgccc

SEQ ID NO: 9193 - RNA, 19 nt, Artificial Sequence
  source: /note="Description of Artificial Sequence: Synthetic oligonucleotide"
agaaccaccuccuuugcgg

SEQ ID NO: 9194 - RNA, 19 nt, Artificial Sequence
  source: /note="Description of Artificial Sequence: Synthetic oligonucleotide"
ccgcaaaggaggugguucu

SEQ ID NO: 9195 - RNA, 19 nt, Artificial Sequence
  source: /note="Description of Artificial Sequence: Synthetic oligonucleotide"
uuuugguagcaugaaaguu

SEQ ID NO: 9196 - RNA, 19 nt, Artificial Sequence
  source: /note="Description of Artificial Sequence: Synthetic oligonucleotide"
aacuuucaugcuaccaaaa

SEQ ID NO: 9197 - RNA, 19 nt, Artificial Sequence
  source: /note="Description of Artificial Sequence: Synthetic oligonucleotide"
cacaggaagucaguuauac

SEQ ID NO: 9198 - RNA, 19 nt, Artificial Sequence
  source: /note="Description of Artificial Sequence: Synthetic oligonucleotide"
guauaacugacuuccugug

SEQ ID NO: 9199 - RNA, 19 nt, Artificial Sequence
  source: /note="Description of Artificial Sequence: Synthetic oligonucleotide"
caggaagucaguuauacag

SEQ ID NO: 9200 - RNA, 19 nt, Artificial Sequence
  source: /note="Description of Artificial Sequence: Synthetic oligonucleotide"
cuguauaacugacuuccug

SEQ ID NO: 9201 - RNA, 19 nt, Artificial Sequence
  source: /note="Description of Artificial Sequence: Synthetic oligonucleotide"
aggaagucaguuauacaga

SEQ ID NO: 9202 - RNA, 19 nt, Artificial Sequence
  source: /note="Description of Artificial Sequence: Synthetic oligonucleotide"
ucuguauaacugacuuccu

SEQ ID NO: 9203 - RNA, 19 nt, Artificial Sequence
  source: /note="Description of Artificial Sequence: Synthetic oligonucleotide"
ggaagucaguuauacagac

SEQ ID NO: 9204 - RNA, 19 nt, Artificial Sequence
  source: /note="Description of Artificial Sequence: Synthetic oligonucleotide"
gucuguauaacugacuucc

SEQ ID NO: 9205 - RNA, 19 nt, Artificial Sequence
  source: /note="Description of Artificial Sequence: Synthetic oligonucleotide"
agugauuggaaauggauca

SEQ ID NO: 9206 - RNA, 19 nt, Artificial Sequence
  source: /note="Description of Artificial Sequence: Synthetic oligonucleotide"
ugauccauuuccaaucacu

SEQ ID NO: 9207 - RNA, 19 nt, Artificial Sequence
  source: /note="Description of Artificial Sequence: Synthetic oligonucleotide"
gugauuggaaauggaucau

SEQ ID NO: 9208 - RNA, 19 nt, Artificial Sequence
  source: /note="Description of Artificial Sequence: Synthetic oligonucleotide"
augauccauuuccaaucac

SEQ ID NO: 9209 - RNA, 19 nt, Artificial Sequence
  source: /note="Description of Artificial Sequence: Synthetic oligonucleotide"
gauuggaaauggaucauuu

SEQ ID NO: 9210 - RNA, 19 nt, Artificial Sequence
  source: /note="Description of Artificial Sequence: Synthetic oligonucleotide"
aaaugauccauuuccaauc

SEQ ID NO: 9211 - RNA, 19 nt, Artificial Sequence
  source: /note="Description of Artificial Sequence: Synthetic oligonucleotide"
uuuggugugguauaucaag

SEQ ID NO: 9212 - RNA, 19 nt, Artificial Sequence
  source: /note="Description of Artificial Sequence: Synthetic oligonucleotide"
cuugauauaccacaccaaa

SEQ ID NO: 9213 - RNA, 19 nt, Artificial Sequence
  source: /note="Description of Artificial Sequence: Synthetic oligonucleotide"
uuggugugguauaucaagc

SEQ ID NO: 9214 - RNA, 19 nt, Artificial Sequence
  source: /note="Description of Artificial Sequence: Synthetic oligonucleotide"
gcuugauauaccacaccaa

SEQ ID NO: 9215 - RNA, 19 nt, Artificial Sequence
  source: /note="Description of Artificial Sequence: Synthetic oligonucleotide"
ggugugguauaucaagcca

SEQ ID NO: 9216 - RNA, 19 nt, Artificial Sequence
  source: /note="Description of Artificial Sequence: Synthetic oligonucleotide"
uggcuugauauaccacacc

SEQ ID NO: 9217 - RNA, 19 nt, Artificial Sequence
  source: /note="Description of Artificial Sequence: Synthetic oligonucleotide"
caagccaaacuuugugauu

SEQ ID NO: 9218 - RNA, 19 nt, Artificial Sequence
  source: /note="Description of Artificial Sequence: Synthetic oligonucleotide"
aaucacaaaguuuggcuug

SEQ ID NO: 9219 - RNA, 19 nt, Artificial Sequence
  source: /note="Description of Artificial Sequence: Synthetic oligonucleotide"
uucuacaggacaagcgauu

SEQ ID NO: 9220 - RNA, 19 nt, Artificial Sequence
  source: /note="Description of Artificial Sequence: Synthetic oligonucleotide"
aaucgcuuguccuguagaa

SEQ ID NO: 9221 - RNA, 19 nt, Artificial Sequence
  source: /note="Description of Artificial Sequence: Synthetic oligonucleotide"
gagaaagcuagaccacugu

SEQ ID NO: 9222 - RNA, 19 nt, Artificial Sequence
  source: /note="Description of Artificial Sequence: Synthetic oligonucleotide"
acaguggucuagcuuucuc

SEQ ID NO: 9223 - RNA, 19 nt, Artificial Sequence
  source: /note="Description of Artificial Sequence: Synthetic oligonucleotide"
agaaagcuagaccacugua

SEQ ID NO: 9224 - RNA, 19 nt, Artificial Sequence
  source: /note="Description of Artificial Sequence: Synthetic oligonucleotide"
uacaguggucuagcuuucu

SEQ ID NO: 9225 - RNA, 19 nt, Artificial Sequence
  source: /note="Description of Artificial Sequence: Synthetic oligonucleotide"
agaccacuguaacauaguc

SEQ ID NO: 9226 - RNA, 19 nt, Artificial Sequence
  source: /note="Description of Artificial Sequence: Synthetic oligonucleotide"
gacuauguuacaguggucu

SEQ ID NO: 9227 - RNA, 19 nt, Artificial Sequence
  source: /note="Description of Artificial Sequence: Synthetic oligonucleotide"
accacuguaacauaguccg

SEQ ID NO: 9228 - RNA, 19 nt, Artificial Sequence
  source: /note="Description of Artificial Sequence: Synthetic oligonucleotide"
cggacuauguuacaguggu

SEQ ID NO: 9229 - RNA, 19 nt, Artificial Sequence
  source: /note="Description of Artificial Sequence: Synthetic oligonucleotide"
cacuguaacauaguccgac

SEQ ID NO: 9230 - RNA, 19 nt, Artificial Sequence
  source: /note="Description of Artificial Sequence: Synthetic oligonucleotide"
gucggacuauguuacagug

SEQ ID NO: 9231 - RNA, 19 nt, Artificial Sequence
  source: /note="Description of Artificial Sequence: Synthetic oligonucleotide"
guauuucuucuacucgagu

SEQ ID NO: 9232 - RNA, 19 nt, Artificial Sequence
  source: /note="Description of Artificial Sequence: Synthetic oligonucleotide"
acucgaguagaagaaauac

SEQ ID NO: 9233 - RNA, 19 nt, Artificial Sequence
  source: /note="Description of Artificial Sequence: Synthetic oligonucleotide"
uauuucuucuacucgagug

SEQ ID NO: 9234 - RNA, 19 nt, Artificial Sequence
  source: /note="Description of Artificial Sequence: Synthetic oligonucleotide"
cacucgaguagaagaaaua

SEQ ID NO: 9235 - RNA, 19 nt, Artificial Sequence
  source: /note="Description of Artificial Sequence: Synthetic oligonucleotide"
uuucuucuacucgaguggu

SEQ ID NO: 9236 - RNA, 19 nt, Artificial Sequence
  source: /note="Description of Artificial Sequence: Synthetic oligonucleotide"
accacucgaguagaagaaa

SEQ ID NO: 9237 - RNA, 19 nt, Artificial Sequence
  source: /note="Description of Artificial Sequence: Synthetic oligonucleotide"
uacucgaguggugagaaga

SEQ ID NO: 9238 - RNA, 19 nt, Artificial Sequence
  source: /note="Description of Artificial Sequence: Synthetic oligonucleotide"
ucuucucaccacucgagua

SEQ ID NO: 9239 - RNA, 19 nt, Artificial Sequence
  source: /note="Description of Artificial Sequence: Synthetic oligonucleotide"
agaugaggucuaccuuaac

SEQ ID NO: 9240 - RNA, 19 nt, Artificial Sequence
  source: /note="Description of Artificial Sequence: Synthetic oligonucleotide"
guuaagguagaccucaucu

SEQ ID NO: 9241 - RNA, 19 nt, Artificial Sequence
  source: /note="Description of Artificial Sequence: Synthetic oligonucleotide"
ggacuauguuccggagaca

SEQ ID NO: 9242 - RNA, 19 nt, Artificial Sequence
  source: /note="Description of Artificial Sequence: Synthetic oligonucleotide"
ugucuccggaacauagucc

SEQ ID NO: 9243 - RNA, 19 nt, Artificial Sequence
  source: /note="Description of Artificial Sequence: Synthetic oligonucleotide"
cagacacuauagucgagcc

SEQ ID NO: 9244 - RNA, 19 nt, Artificial Sequence
  source: /note="Description of Artificial Sequence: Synthetic oligonucleotide"
ggcucgacuauagugucug

SEQ ID NO: 9245 - RNA, 19 nt, Artificial Sequence
  source: /note="Description of Artificial Sequence: Synthetic oligonucleotide"
uauauguaucagcuguuca

SEQ ID NO: 9246 - RNA, 19 nt, Artificial Sequence
  source: /note="Description of Artificial Sequence: Synthetic oligonucleotide"
ugaacagcugauacauaua

SEQ ID NO: 9247 - RNA, 19 nt, Artificial Sequence
  source: /note="Description of Artificial Sequence: Synthetic oligonucleotide"
gcuguucagaagucuagcc

SEQ ID NO: 9248 - RNA, 19 nt, Artificial Sequence
  source: /note="Description of Artificial Sequence: Synthetic oligonucleotide"
ggcuagacuucugaacagc

SEQ ID NO: 9249 - RNA, 19 nt, Artificial Sequence
  source: /note="Description of Artificial Sequence: Synthetic oligonucleotide"
uguucagaagucuagccua

SEQ ID NO: 9250 - RNA, 19 nt, Artificial Sequence
  source: /note="Description of Artificial Sequence: Synthetic oligonucleotide"
uaggcuagacuucugaaca

SEQ ID NO: 9251 - RNA, 19 nt, Artificial Sequence
  source: /note="Description of Artificial Sequence: Synthetic oligonucleotide"
aagucuagccuauauccau

SEQ ID NO: 9252 - RNA, 19 nt, Artificial Sequence
  source: /note="Description of Artificial Sequence: Synthetic oligonucleotide"
auggauauaggcuagacuu

SEQ ID NO: 9253 - RNA, 19 nt, Artificial Sequence
  source: /note="Description of Artificial Sequence: Synthetic oligonucleotide"
gaaucugccaucgagacau

SEQ ID NO: 9254 - RNA, 19 nt, Artificial Sequence
  source: /note="Description of Artificial Sequence: Synthetic oligonucleotide"
augucucgauggcagauuc

SEQ ID NO: 9255 - RNA, 19 nt, Artificial Sequence
  source: /note="Description of Artificial Sequence: Synthetic oligonucleotide"
aaaccacagaaccucuugu

SEQ ID NO: 9256 - RNA, 19 nt, Artificial Sequence
  source: /note="Description of Artificial Sequence: Synthetic oligonucleotide"
acaagagguucugugguuu

SEQ ID NO: 9257 - RNA, 19 nt, Artificial Sequence
  source: /note="Description of Artificial Sequence: Synthetic oligonucleotide"
accucuuguuggauccuga

SEQ ID NO: 9258 - RNA, 19 nt, Artificial Sequence
  source: /note="Description of Artificial Sequence: Synthetic oligonucleotide"
ucaggauccaacaagaggu

SEQ ID NO: 9259 - RNA, 19 nt, Artificial Sequence
  source: /note="Description of Artificial Sequence: Synthetic oligonucleotide"
uguuggauccugauacagc

SEQ ID NO: 9260 - RNA, 19 nt, Artificial Sequence
  source: /note="Description of Artificial Sequence: Synthetic oligonucleotide"
gcuguaucaggauccaaca

SEQ ID NO: 9261 - RNA, 19 nt, Artificial Sequence
  source: /note="Description of Artificial Sequence: Synthetic oligonucleotide"
ccugauacagcuguauuaa

SEQ ID NO: 9262 - RNA, 19 nt, Artificial Sequence
  source: /note="Description of Artificial Sequence: Synthetic oligonucleotide"
uuaauacagcuguaucagg

SEQ ID NO: 9263 - RNA, 19 nt, Artificial Sequence
  source: /note="Description of Artificial Sequence: Synthetic oligonucleotide"
uucauauaucuguucucgg

SEQ ID NO: 9264 - RNA, 19 nt, Artificial Sequence
  source: /note="Description of Artificial Sequence: Synthetic oligonucleotide"
ccgagaacagauauaugaa

SEQ ID NO: 9265 - RNA, 19 nt, Artificial Sequence
  source: /note="Description of Artificial Sequence: Synthetic oligonucleotide"
agggcaccagaguugaucu

SEQ ID NO: 9266 - RNA, 19 nt, Artificial Sequence
  source: /note="Description of Artificial Sequence: Synthetic oligonucleotide"
agaucaacucuggugcccu

SEQ ID NO: 9267 - RNA, 19 nt, Artificial Sequence
  source: /note="Description of Artificial Sequence: Synthetic oligonucleotide"
ggagccacugauuacacgu

SEQ ID NO: 9268 - RNA, 19 nt, Artificial Sequence
  source: /note="Description of Artificial Sequence: Synthetic oligonucleotide"
acguguaaucaguggcucc

SEQ ID NO: 9269 - RNA, 19 nt, Artificial Sequence
  source: /note="Description of Artificial Sequence: Synthetic oligonucleotide"
gagccacugauuacacguc

SEQ ID NO: 9270 - RNA, 19 nt, Artificial Sequence
  source: /note="Description of Artificial Sequence: Synthetic oligonucleotide"
gacguguaaucaguggcuc

SEQ ID NO: 9271 - RNA, 19 nt, Artificial Sequence
  source: /note="Description of Artificial Sequence: Synthetic oligonucleotide"
uacacguccaguauagaug

SEQ ID NO: 9272 - RNA, 19 nt, Artificial Sequence
  source: /note="Description of Artificial Sequence: Synthetic oligonucleotide"
caucuauacuggacgugua

SEQ ID NO: 9273 - RNA, 19 nt, Artificial Sequence
  source: /note="Description of Artificial Sequence: Synthetic oligonucleotide"
cguccaguauagauguaug

SEQ ID NO: 9274 - RNA, 19 nt, Artificial Sequence
  source: /note="Description of Artificial Sequence: Synthetic oligonucleotide"
cauacaucuauacuggacg

SEQ ID NO: 9275 - RNA, 19 nt, Artificial Sequence
  source: /note="Description of Artificial Sequence: Synthetic oligonucleotide"
guccaguauagauguaugg

SEQ ID NO: 9276 - RNA, 19 nt, Artificial Sequence
  source: /note="Description of Artificial Sequence: Synthetic oligonucleotide"
ccauacaucuauacuggac

SEQ ID NO: 9277 - RNA, 19 nt, Artificial Sequence
  source: /note="Description of Artificial Sequence: Synthetic oligonucleotide"
caguauagauguauggucu

SEQ ID NO: 9278 - RNA, 19 nt, Artificial Sequence
  source: /note="Description of Artificial Sequence: Synthetic oligonucleotide"
agaccauacaucuauacug

SEQ ID NO: 9279 - RNA, 19 nt, Artificial Sequence
  source: /note="Description of Artificial Sequence: Synthetic oligonucleotide"
uauagauguauggucugca

SEQ ID NO: 9280 - RNA, 19 nt, Artificial Sequence
  source: /note="Description of Artificial Sequence: Synthetic oligonucleotide"
ugcagaccauacaucuaua

SEQ ID NO: 9281 - RNA, 19 nt, Artificial Sequence
  source: /note="Description of Artificial Sequence: Synthetic oligonucleotide"
agauguauggucugcaggc

SEQ ID NO: 9282 - RNA, 19 nt, Artificial Sequence
  source: /note="Description of Artificial Sequence: Synthetic oligonucleotide"
gccugcagaccauacaucu

SEQ ID NO: 9283 - RNA, 19 nt, Artificial Sequence
  source: /note="Description of Artificial Sequence: Synthetic oligonucleotide"
cugaauuguugcuaggaca

SEQ ID NO: 9284 - RNA, 19 nt, Artificial Sequence
  source: /note="Description of Artificial Sequence: Synthetic oligonucleotide"
uguccuagcaacaauucag

SEQ ID NO: 9285 - RNA, 19 nt, Artificial Sequence
  source: /note="Description of Artificial Sequence: Synthetic oligonucleotide"
gcuaggacaaccaauauuu

SEQ ID NO: 9286 - RNA, 19 nt, Artificial Sequence
  source: /note="Description of Artificial Sequence: Synthetic oligonucleotide"
aaauauugguuguccuagc

SEQ ID NO: 9287 - RNA, 19 nt, Artificial Sequence
  source: /note="Description of Artificial Sequence: Synthetic oligonucleotide"
aaccaauauuuccugggga

SEQ ID NO: 9288 - RNA, 19 nt, Artificial Sequence
  source: /note="Description of Artificial Sequence: Synthetic oligonucleotide"
uccccaggaaauauugguu

SEQ ID NO: 9289 - RNA, 19 nt, Artificial Sequence
  source: /note="Description of Artificial Sequence: Synthetic oligonucleotide"
guccuaggaacaccaacaa

SEQ ID NO: 9290 - RNA, 19 nt, Artificial Sequence
  source: /note="Description of Artificial Sequence: Synthetic oligonucleotide"
uuguugguguuccuaggac

SEQ ID NO: 9291 - RNA, 19 nt, Artificial Sequence
  source: /note="Description of Artificial Sequence: Synthetic oligonucleotide"
uccuaggaacaccaacaag

SEQ ID NO: 9292 - RNA, 19 nt, Artificial Sequence
  source: /note="Description of Artificial Sequence: Synthetic oligonucleotide"
cuuguugguguuccuagga

SEQ ID NO: 9293 - RNA, 19 nt, Artificial Sequence
  source: /note="Description of Artificial Sequence: Synthetic oligonucleotide"
cuaggaacaccaacaaggg

SEQ ID NO: 9294 - RNA, 19 nt, Artificial Sequence
  source: /note="Description of Artificial Sequence: Synthetic oligonucleotide"
cccuuguugguguuccuag

SEQ ID NO: 9295 - RNA, 19 nt, Artificial Sequence
  source: /note="Description of Artificial Sequence: Synthetic oligonucleotide"
aggaacaccaacaagggag

SEQ ID NO: 9296 - RNA, 19 nt, Artificial Sequence
  source: /note="Description of Artificial Sequence: Synthetic oligonucleotide"
cucccuuguugguguuccu

SEQ ID NO: 9297 - RNA, 19 nt, Artificial Sequence
  source: /note="Description of Artificial Sequence: Synthetic oligonucleotide"
caagggagcaaauuagaga

SEQ ID NO: 9298 - RNA, 19 nt, Artificial Sequence
  source: /note="Description of Artificial Sequence: Synthetic oligonucleotide"
ucucuaauuugcucccuug

SEQ ID NO: 9299 - RNA, 19 nt, Artificial Sequence
  source: /note="Description of Artificial Sequence: Synthetic oligonucleotide"
ucaaauucccucaaaucaa

SEQ ID NO: 9300 - RNA, 19 nt, Artificial Sequence
  source: /note="Description of Artificial Sequence: Synthetic oligonucleotide"
uugauuugagggaauuuga

SEQ ID NO: 9301 - RNA, 19 nt, Artificial Sequence
  source: /note="Description of Artificial Sequence: Synthetic oligonucleotide"
ggucuuccggccccgaacu

SEQ ID NO: 9302 - RNA, 19 nt, Artificial Sequence
  source: /note="Description of Artificial Sequence: Synthetic oligonucleotide"
aguucggggccggaagacc

SEQ ID NO: 9303 - RNA, 19 nt, Artificial Sequence
  source: /note="Description of Artificial Sequence: Synthetic oligonucleotide"
gucuuccggccccgaacuc

SEQ ID NO: 9304 - RNA, 19 nt, Artificial Sequence
  source: /note="Description of Artificial Sequence: Synthetic oligonucleotide"
gaguucggggccggaagac

SEQ ID NO: 9305 - RNA, 19 nt, Artificial Sequence
  source: /note="Description of Artificial Sequence: Synthetic oligonucleotide"
cuuccggccccgaacucca

SEQ ID NO: 9306 - RNA, 19 nt, Artificial Sequence
  source: /note="Description of Artificial Sequence: Synthetic oligonucleotide"
uggaguucggggccggaag

SEQ ID NO: 9307 - RNA, 19 nt, Artificial Sequence
  source: /note="Description of Artificial Sequence: Synthetic oligonucleotide"
ccaccagaggcaauugcac

SEQ ID NO: 9308 - RNA, 19 nt, Artificial Sequence
  source: /note="Description of Artificial Sequence: Synthetic oligonucleotide"
gugcaauugccucuggugg

SEQ ID NO: 9309 - RNA, 19 nt, Artificial Sequence
  source: /note="Description of Artificial Sequence: Synthetic oligonucleotide"
ugcacugugcagccgucug

SEQ ID NO: 9310 - RNA, 19 nt, Artificial Sequence
  source: /note="Description of Artificial Sequence: Synthetic oligonucleotide"
cagacggcugcacagugca

SEQ ID NO: 9311 - RNA, 19 nt, Artificial Sequence
  source: /note="Description of Artificial Sequence: Synthetic oligonucleotide"
cuggaguacacaccuaccg

SEQ ID NO: 9312 - RNA, 19 nt, Artificial Sequence
  source: /note="Description of Artificial Sequence: Synthetic oligonucleotide"
cgguagguguguacuccag

SEQ ID NO: 9313 - RNA, 19 nt, Artificial Sequence
  source: /note="Description of Artificial Sequence: Synthetic oligonucleotide"
aguacacaccuaccgcccg

SEQ ID NO: 9314 - RNA, 19 nt, Artificial Sequence
  source: /note="Description of Artificial Sequence: Synthetic oligonucleotide"
cgggcgguagguguguacu

SEQ ID NO: 9315 - RNA, 19 nt, Artificial Sequence
  source: /note="Description of Artificial Sequence: Synthetic oligonucleotide"
cccggcuaacaccacugga

SEQ ID NO: 9316 - RNA, 19 nt, Artificial Sequence
  source: /note="Description of Artificial Sequence: Synthetic oligonucleotide"
uccagugguguuagccggg

SEQ ID NO: 9317 - RNA, 19 nt, Artificial Sequence
  source: /note="Description of Artificial Sequence: Synthetic oligonucleotide"
ggcuaacaccacuggaagc

SEQ ID NO: 9318 - RNA, 19 nt, Artificial Sequence
  source: /note="Description of Artificial Sequence: Synthetic oligonucleotide"
gcuuccagugguguuagcc

SEQ ID NO: 9319 - RNA, 19 nt, Artificial Sequence
  source: /note="Description of Artificial Sequence: Synthetic oligonucleotide"
caguguacagagucgccag

SEQ ID NO: 9320 - RNA, 19 nt, Artificial Sequence
  source: /note="Description of Artificial Sequence: Synthetic oligonucleotide"
cuggcgacucuguacacug

SEQ ID NO: 9321 - RNA, 19 nt, Artificial Sequence
  source: /note="Description of Artificial Sequence: Synthetic oligonucleotide"
ccugugaucuaugucaagu

SEQ ID NO: 9322 - RNA, 19 nt, Artificial Sequence
  source: /note="Description of Artificial Sequence: Synthetic oligonucleotide"
acuugacauagaucacagg

SEQ ID NO: 9323 - RNA, 19 nt, Artificial Sequence
  source: /note="Description of Artificial Sequence: Synthetic oligonucleotide"
uguuucauauaucuguucu

SEQ ID NO: 9324 - RNA, 19 nt, Artificial Sequence
  source: /note="Description of Artificial Sequence: Synthetic oligonucleotide"
agaacagauauaugaaaca

SEQ ID NO: 9325 - RNA, 19 nt, Artificial Sequence
  source: /note="Description of Artificial Sequence: Synthetic oligonucleotide"
guuggcugaauuguugcua

SEQ ID NO: 9326 - RNA, 19 nt, Artificial Sequence
  source: /note="Description of Artificial Sequence: Synthetic oligonucleotide"
uagcaacaauucagccaac

SEQ ID NO: 9327 - RNA, 19 nt, Artificial Sequence
  source: /note="Description of Artificial Sequence: Synthetic oligonucleotide"
uuagagaaaugaacccaaa

SEQ ID NO: 9328 - RNA, 19 nt, Artificial Sequence
  source: /note="Description of Artificial Sequence: Synthetic oligonucleotide"
uuuggguucauuucucuaa

SEQ ID NO: 9329 - RNA, 19 nt, Artificial Sequence
  source: /note="Description of Artificial Sequence: Synthetic oligonucleotide"
auucaaauucccucaaauc

SEQ ID NO: 9330 - RNA, 19 nt, Artificial Sequence
  source: /note="Description of Artificial Sequence: Synthetic oligonucleotide"
gauuugagggaauuugaau

SEQ ID NO: 9331 - RNA, 19 nt, Artificial Sequence
  source: /note="Description of Artificial Sequence: Synthetic oligonucleotide"
uggcagcaagguaaccaca

SEQ ID NO: 9332 - RNA, 19 nt, Artificial Sequence
  source: /note="Description of Artificial Sequence: Synthetic oligonucleotide"
ugugguuaccuugcugcca

SEQ ID NO: 9333 - RNA, 19 nt, Artificial Sequence
  source: /note="Description of Artificial Sequence: Synthetic oligonucleotide"
ucaguuauacagacacgaa

SEQ ID NO: 9334 - RNA, 19 nt, Artificial Sequence
  source: /note="Description of Artificial Sequence: Synthetic oligonucleotide"
uucgugucuguauaacuga

SEQ ID NO: 9335 - RNA, 19 nt, Artificial Sequence
  source: /note="Description of Artificial Sequence: Synthetic oligonucleotide"
acacucccugugaucuaug

SEQ ID NO: 9336 - RNA, 19 nt, Artificial Sequence
  source: /note="Description of Artificial Sequence: Synthetic oligonucleotide"
cauagaucacagggagugu

SEQ ID NO: 9337 - RNA, 19 nt, Artificial Sequence
  source: /note="Description of Artificial Sequence: Synthetic oligonucleotide"
gaaccucuuguuggauccu

SEQ ID NO: 9338 - RNA, 19 nt, Artificial Sequence
  source: /note="Description of Artificial Sequence: Synthetic oligonucleotide"
aggauccaacaagagguuc

SEQ ID NO: 9339 - RNA, 19 nt, Artificial Sequence
  source: /note="Description of Artificial Sequence: Synthetic oligonucleotide"
uggauccugauacagcugu

SEQ ID NO: 9340 - RNA, 19 nt, Artificial Sequence
  source: /note="Description of Artificial Sequence: Synthetic oligonucleotide"
acagcuguaucaggaucca

SEQ ID NO: 9341 - RNA, 19 nt, Artificial Sequence
  source: /note="Description of Artificial Sequence: Synthetic oligonucleotide"
aauguuucauauaucuguu

SEQ ID NO: 9342 - RNA, 19 nt, Artificial Sequence
  source: /note="Description of Artificial Sequence: Synthetic oligonucleotide"
aacagauauaugaaacauu

SEQ ID NO: 9343 - RNA, 19 nt, Artificial Sequence
  source: /note="Description of Artificial Sequence: Synthetic oligonucleotide"
ucuguucucgguacuacag

SEQ ID NO: 9344 - RNA, 19 nt, Artificial Sequence
  source: /note="Description of Artificial Sequence: Synthetic oligonucleotide"
cuguaguaccgagaacaga

SEQ ID NO: 9345 - RNA, 19 nt, Artificial Sequence
  source: /note="Description of Artificial Sequence: Synthetic oligonucleotide"
gcugaauuguugcuaggac

SEQ ID NO: 9346 - RNA, 19 nt, Artificial Sequence
  source: /note="Description of Artificial Sequence: Synthetic oligonucleotide"
guccuagcaacaauucagc

SEQ ID NO: 9347 - RNA, 19 nt, Artificial Sequence
  source: /note="Description of Artificial Sequence: Synthetic oligonucleotide"
gguguggaucaguuggugg

SEQ ID NO: 9348 - RNA, 19 nt, Artificial Sequence
  source: /note="Description of Artificial Sequence: Synthetic oligonucleotide"
ccaccaacugauccacacc

SEQ ID NO: 9349 - RNA, 19 nt, Artificial Sequence
  source: /note="Description of Artificial Sequence: Synthetic oligonucleotide"
cuccaccagaggcaauugc

SEQ ID NO: 9350 - RNA, 19 nt, Artificial Sequence
  source: /note="Description of Artificial Sequence: Synthetic oligonucleotide"
gcaauugccucugguggag

SEQ ID NO: 9351 - RNA, 19 nt, Artificial Sequence
  source: /note="Description of Artificial Sequence: Synthetic oligonucleotide"
caccuccuuugcggagagc

SEQ ID NO: 9352 - RNA, 19 nt, Artificial Sequence
  source: /note="Description of Artificial Sequence: Synthetic oligonucleotide"
gcucuccgcaaaggaggug

SEQ ID NO: 9353 - RNA, 19 nt, Artificial Sequence
  source: /note="Description of Artificial Sequence: Synthetic oligonucleotide"
gacaguguacagagucgcc

SEQ ID NO: 9354 - RNA, 19 nt, Artificial Sequence
  source: /note="Description of Artificial Sequence: Synthetic oligonucleotide"
ggcgacucuguacacuguc

SEQ ID NO: 9355 - RNA, 19 nt, Artificial Sequence
  source: /note="Description of Artificial Sequence: Synthetic oligonucleotide"
uuugguagcaugaaaguua

SEQ ID NO: 9356 - RNA, 19 nt, Artificial Sequence
  source: /note="Description of Artificial Sequence: Synthetic oligonucleotide"
uaacuuucaugcuaccaaa

SEQ ID NO: 9357 - RNA, 19 nt, Artificial Sequence
  source: /note="Description of Artificial Sequence: Synthetic oligonucleotide"
aagauggcagcaagguaac

SEQ ID NO: 9358 - RNA, 19 nt, Artificial Sequence
  source: /note="Description of Artificial Sequence: Synthetic oligonucleotide"
guuaccuugcugccaucuu

SEQ ID NO: 9359 - RNA, 19 nt, Artificial Sequence
  source: /note="Description of Artificial Sequence: Synthetic oligonucleotide"
gccacaggaagucaguuau

SEQ ID NO: 9360 - RNA, 19 nt, Artificial Sequence
  source: /note="Description of Artificial Sequence: Synthetic oligonucleotide"
auaacugacuuccuguggc

SEQ ID NO: 9361 - RNA, 19 nt, Artificial Sequence
  source: /note="Description of Artificial Sequence: Synthetic oligonucleotide"
auuuggugugguauaucaa

SEQ ID NO: 9362 - RNA, 19 nt, Artificial Sequence
  source: /note="Description of Artificial Sequence: Synthetic oligonucleotide"
uugauauaccacaccaaau

SEQ ID NO: 9363 - RNA, 19 nt, Artificial Sequence
  source: /note="Description of Artificial Sequence: Synthetic oligonucleotide"
ucaagccaaacuuugugau

SEQ ID NO: 9364 - RNA, 19 nt, Artificial Sequence
  source: /note="Description of Artificial Sequence: Synthetic oligonucleotide"
aucacaaaguuuggcuuga

SEQ ID NO: 9365 - RNA, 19 nt, Artificial Sequence
  source: /note="Description of Artificial Sequence: Synthetic oligonucleotide"
cuggagaacugguugccau

SEQ ID NO: 9366 - RNA, 19 nt, Artificial Sequence
  source: /note="Description of Artificial Sequence: Synthetic oligonucleotide"
auggcaaccaguucuccag

SEQ ID NO: 9367 - RNA, 19 nt, Artificial Sequence
  source: /note="Description of Artificial Sequence: Synthetic oligonucleotide"
agucuagccuauauccauu

SEQ ID NO: 9368 - RNA, 19 nt, Artificial Sequence
  source: /note="Description of Artificial Sequence: Synthetic oligonucleotide"
aauggauauaggcuagacu

SEQ ID NO: 9369 - RNA, 19 nt, Artificial Sequence
  source: /note="Description of Artificial Sequence: Synthetic oligonucleotide"
ccucuuguuggauccugau

SEQ ID NO: 9370 - RNA, 19 nt, Artificial Sequence
  source: /note="Description of Artificial Sequence: Synthetic oligonucleotide"
aucaggauccaacaagagg

SEQ ID NO: 9371 - RNA, 19 nt, Artificial Sequence
  source: /note="Description of Artificial Sequence: Synthetic oligonucleotide"
cugauacagcuguauuaaa

SEQ ID NO: 9372 - RNA, 19 nt, Artificial Sequence
  source: /note="Description of Artificial Sequence: Synthetic oligonucleotide"
uuuaauacagcuguaucag

SEQ ID NO: 9373 - RNA, 19 nt, Artificial Sequence
  source: /note="Description of Artificial Sequence: Synthetic oligonucleotide"
agcuguauuaaaacucugu

SEQ ID NO: 9374 - RNA, 19 nt, Artificial Sequence
  source: /note="Description of Artificial Sequence: Synthetic oligonucleotide"
acagaguuuuaauacagcu

SEQ ID NO: 9375 - RNA, 19 nt, Artificial Sequence
  source: /note="Description of Artificial Sequence: Synthetic oligonucleotide"
ucuuuggagccacugauua

SEQ ID NO: 9376 - RNA, 19 nt, Artificial Sequence
  source: /note="Description of Artificial Sequence: Synthetic oligonucleotide"
uaaucaguggcuccaaaga

SEQ ID NO: 9377 - RNA, 19 nt, Artificial Sequence
  source: /note="Description of Artificial Sequence: Synthetic oligonucleotide"
uuuggagccacugauuaca

SEQ ID NO: 9378 - RNA, 19 nt, Artificial Sequence
  source: /note="Description of Artificial Sequence: Synthetic oligonucleotide"
uguaaucaguggcuccaaa

SEQ ID NO: 9379 - RNA, 19 nt, Artificial Sequence
  source: /note="Description of Artificial Sequence: Synthetic oligonucleotide"
acagugguguggaucaguu

SEQ ID NO: 9380 - RNA, 19 nt, Artificial Sequence
  source: /note="Description of Artificial Sequence: Synthetic oligonucleotide"
aacugauccacaccacugu

SEQ ID NO: 9381 - RNA, 19 nt, Artificial Sequence
  source: /note="Description of Artificial Sequence: Synthetic oligonucleotide"
aaauaauaaagguccuagg

SEQ ID NO: 9382 - RNA, 19 nt, Artificial Sequence
  source: /note="Description of Artificial Sequence: Synthetic oligonucleotide"
ccuaggaccuuuauuauuu

SEQ ID NO: 9383 - RNA, 19 nt, Artificial Sequence
  source: /note="Description of Artificial Sequence: Synthetic oligonucleotide"
acagaauucaaauucccuc

SEQ ID NO: 9384 - RNA, 19 nt, Artificial Sequence
  source: /note="Description of Artificial Sequence: Synthetic oligonucleotide"
gagggaauuugaauucugu

SEQ ID NO: 9385 - RNA, 19 nt, Artificial Sequence
  source: /note="Description of Artificial Sequence: Synthetic oligonucleotide"
cuguucagaagucuagccu

SEQ ID NO: 9386 - RNA, 19 nt, Artificial Sequence
  source: /note="Description of Artificial Sequence: Synthetic oligonucleotide"
aggcuagacuucugaacag

SEQ ID NO: 9387 - RNA, 19 nt, Artificial Sequence
  source: /note="Description of Artificial Sequence: Synthetic oligonucleotide"
gguccuaggaacaccaaca

SEQ ID NO: 9388 - RNA, 19 nt, Artificial Sequence
  source: /note="Description of Artificial Sequence: Synthetic oligonucleotide"
uguugguguuccuaggacc

SEQ ID NO: 9389 - RNA, 19 nt, Artificial Sequence
  source: /note="Description of Artificial Sequence: Synthetic oligonucleotide"
ccaacaagggagcaaauua

SEQ ID NO: 9390 - RNA, 19 nt, Artificial Sequence
  source: /note="Description of Artificial Sequence: Synthetic oligonucleotide"
uaauuugcucccuuguugg

SEQ ID NO: 9391 - RNA, 19 nt, Artificial Sequence
  source: /note="Description of Artificial Sequence: Synthetic oligonucleotide"
aggucuuccggccccgaac

SEQ ID NO: 9392 - RNA, 19 nt, Artificial Sequence
  source: /note="Description of Artificial Sequence: Synthetic oligonucleotide"
guucggggccggaagaccu

SEQ ID NO: 9393 - RNA, 19 nt, Artificial Sequence
  source: /note="Description of Artificial Sequence: Synthetic oligonucleotide"
ucucgguacuacagggcac

SEQ ID NO: 9394 - RNA, 19 nt, Artificial Sequence
  source: /note="Description of Artificial Sequence: Synthetic oligonucleotide"
gugcccuguaguaccgaga

SEQ ID NO: 9395 - RNA, 19 nt, Artificial Sequence
  source: /note="Description of Artificial Sequence: Synthetic oligonucleotide"
uaguggcaacuccuggcca

SEQ ID NO: 9396 - RNA, 19 nt, Artificial Sequence
  source: /note="Description of Artificial Sequence: Synthetic oligonucleotide"
uggccaggaguugccacua

SEQ ID NO: 9397 - RNA, 19 nt, Artificial Sequence
  source: /note="Description of Artificial Sequence: Synthetic oligonucleotide"
ugagaaagcuagaccacug

SEQ ID NO: 9398 - RNA, 19 nt, Artificial Sequence
  source: /note="Description of Artificial Sequence: Synthetic oligonucleotide"
caguggucuagcuuucuca

SEQ ID NO: 9399 - RNA, 19 nt, Artificial Sequence
  source: /note="Description of Artificial Sequence: Synthetic oligonucleotide"
ugauacagcuguauuaaaa

SEQ ID NO: 9400 - RNA, 19 nt, Artificial Sequence
  source: /note="Description of Artificial Sequence: Synthetic oligonucleotide"
uuuuaauacagcuguauca

SEQ ID NO: 9401 - RNA, 19 nt, Artificial Sequence
  source: /note="Description of Artificial Sequence: Synthetic oligonucleotide"
aggcuguguguuggcugaa

SEQ ID NO: 9402 - RNA, 19 nt, Artificial Sequence
  source: /note="Description of Artificial Sequence: Synthetic oligonucleotide"
uucagccaacacacagccu

SEQ ID NO: 9403 - RNA, 19 nt, Artificial Sequence
  source: /note="Description of Artificial Sequence: Synthetic oligonucleotide"
ggccacaggaagucaguua

SEQ ID NO: 9404 - RNA, 19 nt, Artificial Sequence
  source: /note="Description of Artificial Sequence: Synthetic oligonucleotide"
uaacugacuuccuguggcc

SEQ ID NO: 9405 - RNA, 19 nt, Artificial Sequence
  source: /note="Description of Artificial Sequence: Synthetic oligonucleotide"
acaccuaccgcccggcuaa

SEQ ID NO: 9406 - RNA, 19 nt, Artificial Sequence
  source: /note="Description of Artificial Sequence: Synthetic oligonucleotide"
uuagccgggcgguaggugu

SEQ ID NO: 9407 - RNA, 19 nt, Artificial Sequence
  source: /note="Description of Artificial Sequence: Synthetic oligonucleotide"
acaagcgauuuaagaaccg

SEQ ID NO: 9408 - RNA, 19 nt, Artificial Sequence
  source: /note="Description of Artificial Sequence: Synthetic oligonucleotide"
cgguucuuaaaucgcuugu

SEQ ID NO: 9409 - RNA, 19 nt, Artificial Sequence
  source: /note="Description of Artificial Sequence: Synthetic oligonucleotide"
gcgguauuucuucuacucg

SEQ ID NO: 9410 - RNA, 19 nt, Artificial Sequence
  source: /note="Description of Artificial Sequence: Synthetic oligonucleotide"
cgaguagaagaaauaccgc

SEQ ID NO: 9411 - RNA, 19 nt, Artificial Sequence
  source: /note="Description of Artificial Sequence: Synthetic oligonucleotide"
ugaucuaugucaaguugua

SEQ ID NO: 9412 - RNA, 19 nt, Artificial Sequence
  source: /note="Description of Artificial Sequence: Synthetic oligonucleotide"
uacaacuugacauagauca

SEQ ID NO: 9413 - RNA, 19 nt, Artificial Sequence
  source: /note="Description of Artificial Sequence: Synthetic oligonucleotide"
gaagucuagccuauaucca

SEQ ID NO: 9414 - RNA, 19 nt, Artificial Sequence
  source: /note="Description of Artificial Sequence: Synthetic oligonucleotide"
uggauauaggcuagacuuc

SEQ ID NO: 9415 - RNA, 19 nt, Artificial Sequence
  source: /note="Description of Artificial Sequence: Synthetic oligonucleotide"
gucuagccuauauccauuc

SEQ ID NO: 9416 - RNA, 19 nt, Artificial Sequence
  source: /note="Description of Artificial Sequence: Synthetic oligonucleotide"
gaauggauauaggcuagac

SEQ ID NO: 9417 - RNA, 19 nt, Artificial Sequence
  source: /note="Description of Artificial Sequence: Synthetic oligonucleotide"
ucuagccuauauccauucc

SEQ ID NO: 9418 - RNA, 19 nt, Artificial Sequence
  source: /note="Description of Artificial Sequence: Synthetic oligonucleotide"
ggaauggauauaggcuaga

SEQ ID NO: 9419 - RNA, 19 nt, Artificial Sequence
  source: /note="Description of Artificial Sequence: Synthetic oligonucleotide"
guugcuaggacaaccaaua

SEQ ID NO: 9420 - RNA, 19 nt, Artificial Sequence
  source: /note="Description of Artificial Sequence: Synthetic oligonucleotide"
uauugguuguccuagcaac

SEQ ID NO: 9421 - RNA, 19 nt, Artificial Sequence
  source: /note="Description of Artificial Sequence: Synthetic oligonucleotide"
uugguagcaugaaaguuag

SEQ ID NO: 9422 - RNA, 19 nt, Artificial Sequence
  source: /note="Description of Artificial Sequence: Synthetic oligonucleotide"
cuaacuuucaugcuaccaa

SEQ ID NO: 9423 - RNA, 19 nt, Artificial Sequence
  source: /note="Description of Artificial Sequence: Synthetic oligonucleotide"
uuauacagacacgaaagug

SEQ ID NO: 9424 - RNA, 19 nt, Artificial Sequence
  source: /note="Description of Artificial Sequence: Synthetic oligonucleotide"
cacuuucgugucuguauaa

SEQ ID NO: 9425 - RNA, 19 nt, Artificial Sequence
  source: /note="Description of Artificial Sequence: Synthetic oligonucleotide"
caagcgauuuaagaaccga

SEQ ID NO: 9426 - RNA, 19 nt, Artificial Sequence
  source: /note="Description of Artificial Sequence: Synthetic oligonucleotide"
ucgguucuuaaaucgcuug

SEQ ID NO: 9427 - RNA, 19 nt, Artificial Sequence
  source: /note="Description of Artificial Sequence: Synthetic oligonucleotide"
gaucaugagaaagcuagac

SEQ ID NO: 9428 - RNA, 19 nt, Artificial Sequence
  source: /note="Description of Artificial Sequence: Synthetic oligonucleotide"
gucuagcuuucucaugauc

SEQ ID NO: 9429 - RNA, 19 nt, Artificial Sequence
  source: /note="Description of Artificial Sequence: Synthetic oligonucleotide"
gucuaccuuaaccuggugc

SEQ ID NO: 9430 - RNA, 19 nt, Artificial Sequence
  source: /note="Description of Artificial Sequence: Synthetic oligonucleotide"
gcaccagguuaagguagac

SEQ ID NO: 9431 - RNA, 19 nt, Artificial Sequence
  source: /note="Description of Artificial Sequence: Synthetic oligonucleotide"
auguuccggagacagugua

SEQ ID NO: 9432 - RNA, 19 nt, Artificial Sequence
  source: /note="Description of Artificial Sequence: Synthetic oligonucleotide"
uacacugucuccggaacau

SEQ ID NO: 9433 - RNA, 19 nt, Artificial Sequence
  source: /note="Description of Artificial Sequence: Synthetic oligonucleotide"
gagucgccagacacuauag

SEQ ID NO: 9434 - RNA, 19 nt, Artificial Sequence
  source: /note="Description of Artificial Sequence: Synthetic oligonucleotide"
cuauagugucuggcgacuc

SEQ ID NO: 9435 - RNA, 19 nt, Artificial Sequence
  source: /note="Description of Artificial Sequence: Synthetic oligonucleotide"
gucgccagacacuauaguc

SEQ ID NO: 9436 - RNA, 19 nt, Artificial Sequence
  source: /note="Description of Artificial Sequence: Synthetic oligonucleotide"
gacuauagugucuggcgac

SEQ ID NO: 9437 - RNA, 19 nt, Artificial Sequence
  source: /note="Description of Artificial Sequence: Synthetic oligonucleotide"
gacacuauagucgagccaa

SEQ ID NO: 9438 - RNA, 19 nt, Artificial Sequence
  source: /note="Description of Artificial Sequence: Synthetic oligonucleotide"
uuggcucgacuauaguguc

SEQ ID NO: 9439 - RNA, 19 nt, Artificial Sequence
  source: /note="Description of Artificial Sequence: Synthetic oligonucleotide"
agacacucccugugaucua

SEQ ID NO: 9440 - RNA, 19 nt, Artificial Sequence
  source: /note="Description of Artificial Sequence: Synthetic oligonucleotide"
uagaucacagggagugucu

SEQ ID NO: 9441 - RNA, 19 nt, Artificial Sequence
  source: /note="Description of Artificial Sequence: Synthetic oligonucleotide"
gaucuaugucaaguuguau

SEQ ID NO: 9442 - RNA, 19 nt, Artificial Sequence
  source: /note="Description of Artificial Sequence: Synthetic oligonucleotide"
auacaacuugacauagauc

SEQ ID NO: 9443 - RNA, 19 nt, Artificial Sequence
  source: /note="Description of Artificial Sequence: Synthetic oligonucleotide"
uauguaucagcuguucaga

SEQ ID NO: 9444 - RNA, 19 nt, Artificial Sequence
  source: /note="Description of Artificial Sequence: Synthetic oligonucleotide"
ucugaacagcugauacaua

SEQ ID NO: 9445 - RNA, 19 nt, Artificial Sequence
  source: /note="Description of Artificial Sequence: Synthetic oligonucleotide"
cuuuggaaucugccaucga

SEQ ID NO: 9446 - RNA, 19 nt, Artificial Sequence
  source: /note="Description of Artificial Sequence: Synthetic oligonucleotide"
ucgauggcagauuccaaag

SEQ ID NO: 9447 - RNA, 19 nt, Artificial Sequence
  source: /note="Description of Artificial Sequence: Synthetic oligonucleotide"
acuacagggcaccagaguu

SEQ ID NO: 9448 - RNA, 19 nt, Artificial Sequence
  source: /note="Description of Artificial Sequence: Synthetic oligonucleotide"
aacucuggugcccuguagu

SEQ ID NO: 9449 - RNA, 19 nt, Artificial Sequence
  source: /note="Description of Artificial Sequence: Synthetic oligonucleotide"
gugguguggaucaguuggu

SEQ ID NO: 9450 - RNA, 19 nt, Artificial Sequence
  source: /note="Description of Artificial Sequence: Synthetic oligonucleotide"
accaacugauccacaccac

SEQ ID NO: 9451 - RNA, 19 nt, Artificial Sequence
  source: /note="Description of Artificial Sequence: Synthetic oligonucleotide"
agggagcaaauuagagaaa

SEQ ID NO: 9452 - RNA, 19 nt, Artificial Sequence
  source: /note="Description of Artificial Sequence: Synthetic oligonucleotide"
uuucucuaauuugcucccu

SEQ ID NO: 9453 - RNA, 19 nt, Artificial Sequence
  source: /note="Description of Artificial Sequence: Synthetic oligonucleotide"
ccucaaaucaaggcacauc

SEQ ID NO: 9454 - RNA, 19 nt, Artificial Sequence
  source: /note="Description of Artificial Sequence: Synthetic oligonucleotide"
gaugugccuugauuugagg

SEQ ID NO: 9455 - RNA, 19 nt, Artificial Sequence
  source: /note="Description of Artificial Sequence: Synthetic oligonucleotide"
cugcuggaguacacaccua

SEQ ID NO: 9456 - RNA, 19 nt, Artificial Sequence
  source: /note="Description of Artificial Sequence: Synthetic oligonucleotide"
uagguguguacuccagcag

SEQ ID NO: 9457 - RNA, 19 nt, Artificial Sequence
  source: /note="Description of Artificial Sequence: Synthetic oligonucleotide"
gcaagguaaccacaguagu

SEQ ID NO: 9458 - RNA, 19 nt, Artificial Sequence
  source: /note="Description of Artificial Sequence: Synthetic oligonucleotide"
acuacugugguuaccuugc

SEQ ID NO: 9459 - RNA, 19 nt, Artificial Sequence
  source: /note="Description of Artificial Sequence: Synthetic oligonucleotide"
caagcagacacucccugug

SEQ ID NO: 9460 - RNA, 19 nt, Artificial Sequence
  source: /note="Description of Artificial Sequence: Synthetic oligonucleotide"
cacagggagugucugcuug

SEQ ID NO: 9461 - RNA, 19 nt, Artificial Sequence
  source: /note="Description of Artificial Sequence: Synthetic oligonucleotide"
gauggcagcaagguaacca

SEQ ID NO: 9462 - RNA, 19 nt, Artificial Sequence
  source: /note="Description of Artificial Sequence: Synthetic oligonucleotide"
ugguuaccuugcugccauc

SEQ ID NO: 9463 - RNA, 19 nt, Artificial Sequence
  source: /note="Description of Artificial Sequence: Synthetic oligonucleotide"
uaaccacaguaguggcaac

SEQ ID NO: 9464 - RNA, 19 nt, Artificial Sequence
  source: /note="Description of Artificial Sequence: Synthetic oligonucleotide"
guugccacuacugugguua

SEQ ID NO: 9465 - RNA, 19 nt, Artificial Sequence
  source: /note="Description of Artificial Sequence: Synthetic oligonucleotide"
caggacaagcgauuuaaga

SEQ ID NO: 9466 - RNA, 19 nt, Artificial Sequence
  source: /note="Description of Artificial Sequence: Synthetic oligonucleotide"
ucuuaaaucgcuuguccug

SEQ ID NO: 9467 - RNA, 19 nt, Artificial Sequence
  source: /note="Description of Artificial Sequence: Synthetic oligonucleotide"
uccagaucaugagaaagcu

SEQ ID NO: 9468 - RNA, 19 nt, Artificial Sequence
  source: /note="Description of Artificial Sequence: Synthetic oligonucleotide"
agcuuucucaugaucugga

SEQ ID NO: 9469 - RNA, 19 nt, Artificial Sequence
  source: /note="Description of Artificial Sequence: Synthetic oligonucleotide"
uccgacugcgguauuucuu

SEQ ID NO: 9470 - RNA, 19 nt, Artificial Sequence
  source: /note="Description of Artificial Sequence: Synthetic oligonucleotide"
aagaaauaccgcagucgga

SEQ ID NO: 9471 - RNA, 19 nt, Artificial Sequence
  source: /note="Description of Artificial Sequence: Synthetic oligonucleotide"
guacagagucgccagacac

SEQ ID NO: 9472 - RNA, 19 nt, Artificial Sequence
  source: /note="Description of Artificial Sequence: Synthetic oligonucleotide"
gugucuggcgacucuguac

SEQ ID NO: 9473 - RNA, 19 nt, Artificial Sequence
  source: /note="Description of Artificial Sequence: Synthetic oligonucleotide"
gugaucuaugucaaguugu

SEQ ID NO: 9474 - RNA, 19 nt, Artificial Sequence
  source: /note="Description of Artificial Sequence: Synthetic oligonucleotide"
acaacuugacauagaucac

SEQ ID NO: 9475 - RNA, 19 nt, Artificial Sequence
  source: /note="Description of Artificial Sequence: Synthetic oligonucleotide"
ucugccaucgagacauuaa

SEQ ID NO: 9476 - RNA, 19 nt, Artificial Sequence
  source: /note="Description of Artificial Sequence: Synthetic oligonucleotide"
uuaaugucucgauggcaga

SEQ ID NO: 9477 - RNA, 19 nt, Artificial Sequence
  source: /note="Description of Artificial Sequence: Synthetic oligonucleotide"
ccacugauuacacguccag

SEQ ID NO: 9478 - RNA, 19 nt, Artificial Sequence
  source: /note="Description of Artificial Sequence: Synthetic oligonucleotide"
cuggacguguaaucagugg

SEQ ID NO: 9479 - RNA, 19 nt, Artificial Sequence
  source: /note="Description of Artificial Sequence: Synthetic oligonucleotide"
guauagauguauggucugc

SEQ ID NO: 9480 - RNA, 19 nt, Artificial Sequence
  source: /note="Description of Artificial Sequence: Synthetic oligonucleotide"
gcagaccauacaucuauac

SEQ ID NO: 9481 - RNA, 19 nt, Artificial Sequence
  source: /note="Description of Artificial Sequence: Synthetic oligonucleotide"
uguguguuggcugaauugu

SEQ ID NO: 9482 - RNA, 19 nt, Artificial Sequence
  source: /note="Description of Artificial Sequence: Synthetic oligonucleotide"
acaauucagccaacacaca

SEQ ID NO: 9483 - RNA, 19 nt, Artificial Sequence
  source: /note="Description of Artificial Sequence: Synthetic oligonucleotide"
ugaauuguugcuaggacaa

SEQ ID NO: 9484 - RNA, 19 nt, Artificial Sequence
  source: /note="Description of Artificial Sequence: Synthetic oligonucleotide"
uuguccuagcaacaauuca

SEQ ID NO: 9485 - RNA, 19 nt, Artificial Sequence
  source: /note="Description of Artificial Sequence: Synthetic oligonucleotide"
cccucaaaucaaggcacau

SEQ ID NO: 9486 - RNA, 19 nt, Artificial Sequence
  source: /note="Description of Artificial Sequence: Synthetic oligonucleotide"
augugccuugauuugaggg

SEQ ID NO: 9487 - RNA, 19 nt, Artificial Sequence
  source: /note="Description of Artificial Sequence: Synthetic oligonucleotide"
ccuuggacaaaggucuucc

SEQ ID NO: 9488 - RNA, 19 nt, Artificial Sequence
  source: /note="Description of Artificial Sequence: Synthetic oligonucleotide"
ggaagaccuuuguccaagg

SEQ ID NO: 9489 - RNA, 19 nt, Artificial Sequence
  source: /note="Description of Artificial Sequence: Synthetic oligonucleotide"
accagaggcaauugcacug

SEQ ID NO: 9490 - RNA, 19 nt, Artificial Sequence
  source: /note="Description of Artificial Sequence: Synthetic oligonucleotide"
cagugcaauugccucuggu

SEQ ID NO: 9491 - RNA, 19 nt, Artificial Sequence
  source: /note="Description of Artificial Sequence: Synthetic oligonucleotide"
ucagcuuuugguagcauga

SEQ ID NO: 9492 - RNA, 19 nt, Artificial Sequence
  source: /note="Description of Artificial Sequence: Synthetic oligonucleotide"
ucaugcuaccaaaagcuga

SEQ ID NO: 9493 - RNA, 19 nt, Artificial Sequence
  source: /note="Description of Artificial Sequence: Synthetic oligonucleotide"
augaaaguuagcagagaua

SEQ ID NO: 9494 - RNA, 19 nt, Artificial Sequence
  source: /note="Description of Artificial Sequence: Synthetic oligonucleotide"
uaucucugcuaacuuucau

SEQ ID NO: 9495 - RNA, 19 nt, Artificial Sequence
  source: /note="Description of Artificial Sequence: Synthetic oligonucleotide"
agauggcagcaagguaacc

SEQ ID NO: 9496 - RNA, 19 nt, Artificial Sequence
  source: /note="Description of Artificial Sequence: Synthetic oligonucleotide"
gguuaccuugcugccaucu

SEQ ID NO: 9497 - RNA, 19 nt, Artificial Sequence
  source: /note="Description of Artificial Sequence: Synthetic oligonucleotide"
gcagcaagguaaccacagu

SEQ ID NO: 9498 - RNA, 19 nt, Artificial Sequence
  source: /note="Description of Artificial Sequence: Synthetic oligonucleotide"
acugugguuaccuugcugc

SEQ ID NO: 9499 - RNA, 19 nt, Artificial Sequence
  source: /note="Description of Artificial Sequence: Synthetic oligonucleotide"
ggccaggguccugacaggc

SEQ ID NO: 9500 - RNA, 19 nt, Artificial Sequence
  source: /note="Description of Artificial Sequence: Synthetic oligonucleotide"
gccugucaggacccuggcc

SEQ ID NO: 9501 - RNA, 19 nt, Artificial Sequence
  source: /note="Description of Artificial Sequence: Synthetic oligonucleotide"
aagucaguuauacagacac

SEQ ID NO: 9502 - RNA, 19 nt, Artificial Sequence
  source: /note="Description of Artificial Sequence: Synthetic oligonucleotide"
gugucuguauaacugacuu

SEQ ID NO: 9503 - RNA, 19 nt, Artificial Sequence
  source: /note="Description of Artificial Sequence: Synthetic oligonucleotide"
auuggaaauggaucauuug

SEQ ID NO: 9504 - RNA, 19 nt, Artificial Sequence
  source: /note="Description of Artificial Sequence: Synthetic oligonucleotide"
caaaugauccauuuccaau

SEQ ID NO: 9505 - RNA, 19 nt, Artificial Sequence
  source: /note="Description of Artificial Sequence: Synthetic oligonucleotide"
uuggaaauggaucauuugg

SEQ ID NO: 9506 - RNA, 19 nt, Artificial Sequence
  source: /note="Description of Artificial Sequence: Synthetic oligonucleotide"
ccaaaugauccauuuccaa

SEQ ID NO: 9507 - RNA, 19 nt, Artificial Sequence
  source: /note="Description of Artificial Sequence: Synthetic oligonucleotide"
uggugugguauaucaagcc

SEQ ID NO: 9508 - RNA, 19 nt, Artificial Sequence
  source: /note="Description of Artificial Sequence: Synthetic oligonucleotide"
ggcuugauauaccacacca

SEQ ID NO: 9509 - RNA, 19 nt, Artificial Sequence
  source: /note="Description of Artificial Sequence: Synthetic oligonucleotide"
aagccaaacuuugugauuc

SEQ ID NO: 9510 - RNA, 19 nt, Artificial Sequence
  source: /note="Description of Artificial Sequence: Synthetic oligonucleotide"
gaaucacaaaguuuggcuu

SEQ ID NO: 9511 - RNA, 19 nt, Artificial Sequence
  source: /note="Description of Artificial Sequence: Synthetic oligonucleotide"
gauucuggagaacugguug

SEQ ID NO: 9512 - RNA, 19 nt, Artificial Sequence
  source: /note="Description of Artificial Sequence: Synthetic oligonucleotide"
caaccaguucuccagaauc

SEQ ID NO: 9513 - RNA, 19 nt, Artificial Sequence
  source: /note="Description of Artificial Sequence: Synthetic oligonucleotide"
auucuggagaacugguugc

SEQ ID NO: 9514 - RNA, 19 nt, Artificial Sequence
  source: /note="Description of Artificial Sequence: Synthetic oligonucleotide"
gcaaccaguucuccagaau

SEQ ID NO: 9515 - RNA, 19 nt, Artificial Sequence
  source: /note="Description of Artificial Sequence: Synthetic oligonucleotide"
ucuggagaacugguugcca

SEQ ID NO: 9516 - RNA, 19 nt, Artificial Sequence
  source: /note="Description of Artificial Sequence: Synthetic oligonucleotide"
uggcaaccaguucuccaga

SEQ ID NO: 9517 - RNA, 19 nt, Artificial Sequence
  source: /note="Description of Artificial Sequence: Synthetic oligonucleotide"
ucuacaggacaagcgauuu

SEQ ID NO: 9518 - RNA, 19 nt, Artificial Sequence
  source: /note="Description of Artificial Sequence: Synthetic oligonucleotide"
aaaucgcuuguccuguaga

SEQ ID NO: 9519 - RNA, 19 nt, Artificial Sequence
  source: /note="Description of Artificial Sequence: Synthetic oligonucleotide"
gcuagaccacuguaacaua

SEQ ID NO: 9520 - RNA, 19 nt, Artificial Sequence
  source: /note="Description of Artificial Sequence: Synthetic oligonucleotide"
uauguuacaguggucuagc

SEQ ID NO: 9521 - RNA, 19 nt, Artificial Sequence
  source: /note="Description of Artificial Sequence: Synthetic oligonucleotide"
gagaagaaagaugaggucu

SEQ ID NO: 9522 - RNA, 19 nt, Artificial Sequence
  source: /note="Description of Artificial Sequence: Synthetic oligonucleotide"
agaccucaucuuucuucuc

SEQ ID NO: 9523 - RNA, 19 nt, Artificial Sequence
  source: /note="Description of Artificial Sequence: Synthetic oligonucleotide"
agaagaaagaugaggucua

SEQ ID NO: 9524 - RNA, 19 nt, Artificial Sequence
  source: /note="Description of Artificial Sequence: Synthetic oligonucleotide"
uagaccucaucuuucuucu

SEQ ID NO: 9525 - RNA, 19 nt, Artificial Sequence
  source: /note="Description of Artificial Sequence: Synthetic oligonucleotide"
aaagaugaggucuaccuua

SEQ ID NO: 9526 - RNA, 19 nt, Artificial Sequence
  source: /note="Description of Artificial Sequence: Synthetic oligonucleotide"
uaagguagaccucaucuuu

SEQ ID NO: 9527 - RNA, 19 nt, Artificial Sequence
  source: /note="Description of Artificial Sequence: Synthetic oligonucleotide"
aagaugaggucuaccuuaa

SEQ ID NO: 9528 - RNA, 19 nt, Artificial Sequence
  source: /note="Description of Artificial Sequence: Synthetic oligonucleotide"
uuaagguagaccucaucuu

SEQ ID NO: 9529 - RNA, 19 nt, Artificial Sequence
  source: /note="Description of Artificial Sequence: Synthetic oligonucleotide"
uauguuccggagacagugu

SEQ ID NO: 9530 - RNA, 19 nt, Artificial Sequence
  source: /note="Description of Artificial Sequence: Synthetic oligonucleotide"
acacugucuccggaacaua

SEQ ID NO: 9531 - RNA, 19 nt, Artificial Sequence
  source: /note="Description of Artificial Sequence: Synthetic oligonucleotide"
acaguguacagagucgcca

SEQ ID NO: 9532 - RNA, 19 nt, Artificial Sequence
  source: /note="Description of Artificial Sequence: Synthetic oligonucleotide"
uggcgacucuguacacugu

SEQ ID NO: 9533 - RNA, 19 nt, Artificial Sequence
  source: /note="Description of Artificial Sequence: Synthetic oligonucleotide"
gacacucccugugaucuau

SEQ ID NO: 9534 - RNA, 19 nt, Artificial Sequence
  source: /note="Description of Artificial Sequence: Synthetic oligonucleotide"
auagaucacagggaguguc

SEQ ID NO: 9535 - RNA, 19 nt, Artificial Sequence
  source: /note="Description of Artificial Sequence: Synthetic oligonucleotide"
cacucccugugaucuaugu

SEQ ID NO: 9536 - RNA, 19 nt, Artificial Sequence
  source: /note="Description of Artificial Sequence: Synthetic oligonucleotide"
acauagaucacagggagug

SEQ ID NO: 9537 - RNA, 19 nt, Artificial Sequence
  source: /note="Description of Artificial Sequence: Synthetic oligonucleotide"
guauauguaucagcuguuc

SEQ ID NO: 9538 - RNA, 19 nt, Artificial Sequence
  source: /note="Description of Artificial Sequence: Synthetic oligonucleotide"
gaacagcugauacauauac

SEQ ID NO: 9539 - RNA, 19 nt, Artificial Sequence
  source: /note="Description of Artificial Sequence: Synthetic oligonucleotide"
accacagaaccucuuguug

SEQ ID NO: 9540 - RNA, 19 nt, Artificial Sequence
  source: /note="Description of Artificial Sequence: Synthetic oligonucleotide"
caacaagagguucuguggu

SEQ ID NO: 9541 - RNA, 19 nt, Artificial Sequence
  source: /note="Description of Artificial Sequence: Synthetic oligonucleotide"
aaccucuuguuggauccug

SEQ ID NO: 9542 - RNA, 19 nt, Artificial Sequence
  source: /note="Description of Artificial Sequence: Synthetic oligonucleotide"
caggauccaacaagagguu

SEQ ID NO: 9543 - RNA, 19 nt, Artificial Sequence
  source: /note="Description of Artificial Sequence: Synthetic oligonucleotide"
auccugauacagcuguauu

SEQ ID NO: 9544 - RNA, 19 nt, Artificial Sequence
  source: /note="Description of Artificial Sequence: Synthetic oligonucleotide"
aauacagcuguaucaggau

SEQ ID NO: 9545 - RNA, 19 nt, Artificial Sequence
  source: /note="Description of Artificial Sequence: Synthetic oligonucleotide"
uacagcuguauuaaaacuc

SEQ ID NO: 9546 - RNA, 19 nt, Artificial Sequence
  source: /note="Description of Artificial Sequence: Synthetic oligonucleotide"
gaguuuuaauacagcugua

SEQ ID NO: 9547 - RNA, 19 nt, Artificial Sequence
  source: /note="Description of Artificial Sequence: Synthetic oligonucleotide"
aagcagcugguccgaggag

SEQ ID NO: 9548 - RNA, 19 nt, Artificial Sequence
  source: /note="Description of Artificial Sequence: Synthetic oligonucleotide"
cuccucggaccagcugcuu

SEQ ID NO: 9549 - RNA, 19 nt, Artificial Sequence
  source: /note="Description of Artificial Sequence: Synthetic oligonucleotide"
caauguuucauauaucugu

SEQ ID NO: 9550 - RNA, 19 nt, Artificial Sequence
  source: /note="Description of Artificial Sequence: Synthetic oligonucleotide"
acagauauaugaaacauug

SEQ ID NO: 9551 - RNA, 19 nt, Artificial Sequence
  source: /note="Description of Artificial Sequence: Synthetic oligonucleotide"
uauaucuguucucgguacu

SEQ ID NO: 9552 - RNA, 19 nt, Artificial Sequence
  source: /note="Description of Artificial Sequence: Synthetic oligonucleotide"
aguaccgagaacagauaua

SEQ ID NO: 9553 - RNA, 19 nt, Artificial Sequence
  source: /note="Description of Artificial Sequence: Synthetic oligonucleotide"
guucucgguacuacagggc

SEQ ID NO: 9554 - RNA, 19 nt, Artificial Sequence
  source: /note="Description of Artificial Sequence: Synthetic oligonucleotide"
gcccuguaguaccgagaac

SEQ ID NO: 9555 - RNA, 19 nt, Artificial Sequence
  source: /note="Description of Artificial Sequence: Synthetic oligonucleotide"
gggcaccagaguugaucuu

SEQ ID NO: 9556 - RNA, 19 nt, Artificial Sequence
  source: /note="Description of Artificial Sequence: Synthetic oligonucleotide"
aagaucaacucuggugccc

SEQ ID NO: 9557 - RNA, 19 nt, Artificial Sequence
  source: /note="Description of Artificial Sequence: Synthetic oligonucleotide"
accagaguugaucuuugga

SEQ ID NO: 9558 - RNA, 19 nt, Artificial Sequence
  source: /note="Description of Artificial Sequence: Synthetic oligonucleotide"
uccaaagaucaacucuggu

SEQ ID NO: 9559 - RNA, 19 nt, Artificial Sequence
  source: /note="Description of Artificial Sequence: Synthetic oligonucleotide"
cuuuggagccacugauuac

SEQ ID NO: 9560 - RNA, 19 nt, Artificial Sequence
  source: /note="Description of Artificial Sequence: Synthetic oligonucleotide"
guaaucaguggcuccaaag

SEQ ID NO: 9561 - RNA, 19 nt, Artificial Sequence
  source: /note="Description of Artificial Sequence: Synthetic oligonucleotide"
agccacugauuacacgucc

SEQ ID NO: 9562 - RNA, 19 nt, Artificial Sequence
  source: /note="Description of Artificial Sequence: Synthetic oligonucleotide"
ggacguguaaucaguggcu

SEQ ID NO: 9563 - RNA, 19 nt, Artificial Sequence
  source: /note="Description of Artificial Sequence: Synthetic oligonucleotide"
uccaguauagauguauggu

SEQ ID NO: 9564 - RNA, 19 nt, Artificial Sequence
  source: /note="Description of Artificial Sequence: Synthetic oligonucleotide"
accauacaucuauacugga

SEQ ID NO: 9565 - RNA, 19 nt, Artificial Sequence
  source: /note="Description of Artificial Sequence: Synthetic oligonucleotide"
ugguguggaucaguuggug

SEQ ID NO: 9566 - RNA, 19 nt, Artificial Sequence
  source: /note="Description of Artificial Sequence: Synthetic oligonucleotide"
caccaacugauccacacca

SEQ ID NO: 9567 - RNA, 19 nt, Artificial Sequence
  source: /note="Description of Artificial Sequence: Synthetic oligonucleotide"
uaaagguccuaggaacacc

SEQ ID NO: 9568 - RNA, 19 nt, Artificial Sequence
  source: /note="Description of Artificial Sequence: Synthetic oligonucleotide"
gguguuccuaggaccuuua

SEQ ID NO: 9569 - RNA, 19 nt, Artificial Sequence
  source: /note="Description of Artificial Sequence: Synthetic oligonucleotide"
aagguccuaggaacaccaa

SEQ ID NO: 9570 - RNA, 19 nt, Artificial Sequence
  source: /note="Description of Artificial Sequence: Synthetic oligonucleotide"
uugguguuccuaggaccuu

SEQ ID NO: 9571 - RNA, 19 nt, Artificial Sequence
  source: /note="Description of Artificial Sequence: Synthetic oligonucleotide"
agguccuaggaacaccaac

SEQ ID NO: 9572 - RNA, 19 nt, Artificial Sequence
  source: /note="Description of Artificial Sequence: Synthetic oligonucleotide"
guugguguuccuaggaccu

SEQ ID NO: 9573 - RNA, 19 nt, Artificial Sequence
  source: /note="Description of Artificial Sequence: Synthetic oligonucleotide"
uaggaacaccaacaaggga

SEQ ID NO: 9574 - RNA, 19 nt, Artificial Sequence
  source: /note="Description of Artificial Sequence: Synthetic oligonucleotide"
ucccuuguugguguuccua

SEQ ID NO: 9575 - RNA, 19 nt, Artificial Sequence
  source: /note="Description of Artificial Sequence: Synthetic oligonucleotide"
caacaagggagcaaauuag

SEQ ID NO: 9576 - RNA, 19 nt, Artificial Sequence
  source: /note="Description of Artificial Sequence: Synthetic oligonucleotide"
cuaauuugcucccuuguug

SEQ ID NO: 9577 - RNA, 19 nt, Artificial Sequence
  source: /note="Description of Artificial Sequence: Synthetic oligonucleotide"
gagaaaugaacccaaauua

SEQ ID NO: 9578 - RNA, 19 nt, Artificial Sequence
  source: /note="Description of Artificial Sequence: Synthetic oligonucleotide"
uaauuuggguucauuucuc

SEQ ID NO: 9579 - RNA, 19 nt, Artificial Sequence
  source: /note="Description of Artificial Sequence: Synthetic oligonucleotide"
auuauacagaauucaaauu

SEQ ID NO: 9580 - RNA, 19 nt, Artificial Sequence
  source: /note="Description of Artificial Sequence: Synthetic oligonucleotide"
aauuugaauucuguauaau

SEQ ID NO: 9581 - RNA, 19 nt, Artificial Sequence
  source: /note="Description of Artificial Sequence: Synthetic oligonucleotide"
agaauucaaauucccucaa

SEQ ID NO: 9582 - RNA, 19 nt, Artificial Sequence
  source: /note="Description of Artificial Sequence: Synthetic oligonucleotide"
uugagggaauuugaauucu

SEQ ID NO: 9583 - RNA, 19 nt, Artificial Sequence
  source: /note="Description of Artificial Sequence: Synthetic oligonucleotide"
gaauucaaauucccucaaa

SEQ ID NO: 9584 - RNA, 19 nt, Artificial Sequence
  source: /note="Description of Artificial Sequence: Synthetic oligonucleotide"
uuugagggaauuugaauuc

SEQ ID NO: 9585 - RNA, 19 nt, Artificial Sequence
  source: /note="Description of Artificial Sequence: Synthetic oligonucleotide"
ucccucaaaucaaggcaca

SEQ ID NO: 9586 - RNA, 19 nt, Artificial Sequence
  source: /note="Description of Artificial Sequence: Synthetic oligonucleotide"
ugugccuugauuugaggga

SEQ ID NO: 9587 - RNA, 19 nt, Artificial Sequence
  source: /note="Description of Artificial Sequence: Synthetic oligonucleotide"
auccuuggacaaaggucuu

SEQ ID NO: 9588 - RNA, 19 nt, Artificial Sequence
  source: /note="Description of Artificial Sequence: Synthetic oligonucleotide"
aagaccuuuguccaaggau

SEQ ID NO: 9589 - RNA, 19 nt, Artificial Sequence
  source: /note="Description of Artificial Sequence: Synthetic oligonucleotide"
cuuggacaaaggucuuccg

SEQ ID NO: 9590 - RNA, 19 nt, Artificial Sequence
  source: /note="Description of Artificial Sequence: Synthetic oligonucleotide"
cggaagaccuuuguccaag

SEQ ID NO: 9591 - RNA, 19 nt, Artificial Sequence
  source: /note="Description of Artificial Sequence: Synthetic oligonucleotide"
caccagaggcaauugcacu

SEQ ID NO: 9592 - RNA, 19 nt, Artificial Sequence
  source: /note="Description of Artificial Sequence: Synthetic oligonucleotide"
agugcaauugccucuggug

SEQ ID NO: 9593 - RNA, 19 nt, Artificial Sequence
  source: /note="Description of Artificial Sequence: Synthetic oligonucleotide"
gcacugugcagccgucugc

SEQ ID NO: 9594 - RNA, 19 nt, Artificial Sequence
  source: /note="Description of Artificial Sequence: Synthetic oligonucleotide"
gcagacggcugcacagugc

SEQ ID NO: 9595 - RNA, 19 nt, Artificial Sequence
  source: /note="Description of Artificial Sequence: Synthetic oligonucleotide"
cacugugcagccgucugcu

SEQ ID NO: 9596 - RNA, 19 nt, Artificial Sequence
  source: /note="Description of Artificial Sequence: Synthetic oligonucleotide"
agcagacggcugcacagug

SEQ ID NO: 9597 - RNA, 19 nt, Artificial Sequence
  source: /note="Description of Artificial Sequence: Synthetic oligonucleotide"
ccacuggaagcuugugcac

SEQ ID NO: 9598 - RNA, 19 nt, Artificial Sequence
  source: /note="Description of Artificial Sequence: Synthetic oligonucleotide"
gugcacaagcuuccagugg

SEQ ID NO: 9599 - RNA, 19 nt, Artificial Sequence
  source: /note="Description of Artificial Sequence: Synthetic oligonucleotide"
gagagcugcaagccagugc

SEQ ID NO: 9600 - RNA, 19 nt, Artificial Sequence
  source: /note="Description of Artificial Sequence: Synthetic oligonucleotide"
gcacuggcuugcagcucuc

SEQ ID NO: 9601 - RNA, 19 nt, Artificial Sequence
  source: /note="Description of Artificial Sequence: Synthetic oligonucleotide"
ccacaggaagucaguuaua

SEQ ID NO: 9602 - RNA, 19 nt, Artificial Sequence
  source: /note="Description of Artificial Sequence: Synthetic oligonucleotide"
uauaacugacuuccugugg

SEQ ID NO: 9603 - RNA, 19 nt, Artificial Sequence
  source: /note="Description of Artificial Sequence: Synthetic oligonucleotide"
augaggucuaccuuaaccu

SEQ ID NO: 9604 - RNA, 19 nt, Artificial Sequence
  source: /note="Description of Artificial Sequence: Synthetic oligonucleotide"
agguuaagguagaccucau

SEQ ID NO: 9605 - RNA, 19 nt, Artificial Sequence
  source: /note="Description of Artificial Sequence: Synthetic oligonucleotide"
uguuggcugaauuguugcu

SEQ ID NO: 9606 - RNA, 19 nt, Artificial Sequence
  source: /note="Description of Artificial Sequence: Synthetic oligonucleotide"
agcaacaauucagccaaca

SEQ ID NO: 9607 - RNA, 19 nt, Artificial Sequence
  source: /note="Description of Artificial Sequence: Synthetic oligonucleotide"
gaauuguugcuaggacaac

SEQ ID NO: 9608 - RNA, 19 nt, Artificial Sequence
  source: /note="Description of Artificial Sequence: Synthetic oligonucleotide"
guuguccuagcaacaauuc

SEQ ID NO: 9609 - RNA, 19 nt, Artificial Sequence
  source: /note="Description of Artificial Sequence: Synthetic oligonucleotide"
gcagcagccuucagcuuuu

SEQ ID NO: 9610 - RNA, 19 nt, Artificial Sequence
  source: /note="Description of Artificial Sequence: Synthetic oligonucleotide"
aaaagcugaaggcugcugc

SEQ ID NO: 9611 - RNA, 19 nt, Artificial Sequence
  source: /note="Description of Artificial Sequence: Synthetic oligonucleotide"
cagcagccuucagcuuuug

SEQ ID NO: 9612 - RNA, 19 nt, Artificial Sequence
  source: /note="Description of Artificial Sequence: Synthetic oligonucleotide"
caaaagcugaaggcugcug

SEQ ID NO: 9613 - RNA, 19 nt, Artificial Sequence
  source: /note="Description of Artificial Sequence: Synthetic oligonucleotide"
auggcagcaagguaaccac

SEQ ID NO: 9614 - RNA, 19 nt, Artificial Sequence
  source: /note="Description of Artificial Sequence: Synthetic oligonucleotide"
gugguuaccuugcugccau

SEQ ID NO: 9615 - RNA, 19 nt, Artificial Sequence
  source: /note="Description of Artificial Sequence: Synthetic oligonucleotide"
aguggcaacuccuggccag

SEQ ID NO: 9616 - RNA, 19 nt, Artificial Sequence
  source: /note="Description of Artificial Sequence: Synthetic oligonucleotide"
cuggccaggaguugccacu

SEQ ID NO: 9617 - RNA, 19 nt, Artificial Sequence
  source: /note="Description of Artificial Sequence: Synthetic oligonucleotide"
gccaaacuuugugauucug

SEQ ID NO: 9618 - RNA, 19 nt, Artificial Sequence
  source: /note="Description of Artificial Sequence: Synthetic oligonucleotide"
cagaaucacaaaguuuggc

SEQ ID NO: 9619 - RNA, 19 nt, Artificial Sequence
  source: /note="Description of Artificial Sequence: Synthetic oligonucleotide"
aagaaaguucuacaggaca

SEQ ID NO: 9620 - RNA, 19 nt, Artificial Sequence
  source: /note="Description of Artificial Sequence: Synthetic oligonucleotide"
uguccuguagaacuuucuu

SEQ ID NO: 9621 - RNA, 19 nt, Artificial Sequence
  source: /note="Description of Artificial Sequence: Synthetic oligonucleotide"
uggacuauguuccggagac

SEQ ID NO: 9622 - RNA, 19 nt, Artificial Sequence
  source: /note="Description of Artificial Sequence: Synthetic oligonucleotide"
gucuccggaacauagucca

SEQ ID NO: 9623 - RNA, 19 nt, Artificial Sequence
  source: /note="Description of Artificial Sequence: Synthetic oligonucleotide"
aagcagacacucccuguga

SEQ ID NO: 9624 - RNA, 19 nt, Artificial Sequence
  source: /note="Description of Artificial Sequence: Synthetic oligonucleotide"
ucacagggagugucugcuu

SEQ ID NO: 9625 - RNA, 19 nt, Artificial Sequence
  source: /note="Description of Artificial Sequence: Synthetic oligonucleotide"
cccugugaucuaugucaag

SEQ ID NO: 9626 - RNA, 19 nt, Artificial Sequence
  source: /note="Description of Artificial Sequence: Synthetic oligonucleotide"
cuugacauagaucacaggg

SEQ ID NO: 9627 - RNA, 19 nt, Artificial Sequence
  source: /note="Description of Artificial Sequence: Synthetic oligonucleotide"
ucuuguuggauccugauac

SEQ ID NO: 9628 - RNA, 19 nt, Artificial Sequence
  source: /note="Description of Artificial Sequence: Synthetic oligonucleotide"
guaucaggauccaacaaga

SEQ ID NO: 9629 - RNA, 19 nt, Artificial Sequence
  source: /note="Description of Artificial Sequence: Synthetic oligonucleotide"
uuggauccugauacagcug

SEQ ID NO: 9630 - RNA, 19 nt, Artificial Sequence
  source: /note="Description of Artificial Sequence: Synthetic oligonucleotide"
cagcuguaucaggauccaa

SEQ ID NO: 9631 - RNA, 19 nt, Artificial Sequence
  source: /note="Description of Artificial Sequence: Synthetic oligonucleotide"
auauaucuguucucgguac

SEQ ID NO: 9632 - RNA, 19 nt, Artificial Sequence
  source: /note="Description of Artificial Sequence: Synthetic oligonucleotide"
guaccgagaacagauauau

SEQ ID NO: 9633 - RNA, 19 nt, Artificial Sequence
  source: /note="Description of Artificial Sequence: Synthetic oligonucleotide"
agaguugaucuuuggagcc

SEQ ID NO: 9634 - RNA, 19 nt, Artificial Sequence
  source: /note="Description of Artificial Sequence: Synthetic oligonucleotide"
ggcuccaaagaucaacucu

SEQ ID NO: 9635 - RNA, 19 nt, Artificial Sequence
  source: /note="Description of Artificial Sequence: Synthetic oligonucleotide"
caggcuguguguuggcuga

SEQ ID NO: 9636 - RNA, 19 nt, Artificial Sequence
  source: /note="Description of Artificial Sequence: Synthetic oligonucleotide"
ucagccaacacacagccug

SEQ ID NO: 9637 - RNA, 19 nt, Artificial Sequence
  source: /note="Description of Artificial Sequence: Synthetic oligonucleotide"
uuggcugaauuguugcuag

SEQ ID NO: 9638 - RNA, 19 nt, Artificial Sequence
  source: /note="Description of Artificial Sequence: Synthetic oligonucleotide"
cuagcaacaauucagccaa

SEQ ID NO: 9639 - RNA, 19 nt, Artificial Sequence
  source: /note="Description of Artificial Sequence: Synthetic oligonucleotide"
caaccaauauuuccugggg

SEQ ID NO: 9640 - RNA, 19 nt, Artificial Sequence
  source: /note="Description of Artificial Sequence: Synthetic oligonucleotide"
ccccaggaaauauugguug

SEQ ID NO: 9641 - RNA, 19 nt, Artificial Sequence
  source: /note="Description of Artificial Sequence: Synthetic oligonucleotide"
gaucaguugguggaaauaa

SEQ ID NO: 9642 - RNA, 19 nt, Artificial Sequence
  source: /note="Description of Artificial Sequence: Synthetic oligonucleotide"
uuauuuccaccaacugauc

SEQ ID NO: 9643 - RNA, 19 nt, Artificial Sequence
  source: /note="Description of Artificial Sequence: Synthetic oligonucleotide"
uccaccagaggcaauugca

SEQ ID NO: 9644 - RNA, 19 nt, Artificial Sequence
  source: /note="Description of Artificial Sequence: Synthetic oligonucleotide"
ugcaauugccucuggugga

SEQ ID NO: 9645 - RNA, 19 nt, Artificial Sequence
  source: /note="Description of Artificial Sequence: Synthetic oligonucleotide"
cgcccggcuaacaccacug

SEQ ID NO: 9646 - RNA, 19 nt, Artificial Sequence
  source: /note="Description of Artificial Sequence: Synthetic oligonucleotide"
cagugguguuagccgggcg

SEQ ID NO: 9647 - RNA, 19 nt, Artificial Sequence
  source: /note="Description of Artificial Sequence: Synthetic oligonucleotide"
gcccggcuaacaccacugg

SEQ ID NO: 9648 - RNA, 19 nt, Artificial Sequence
  source: /note="Description of Artificial Sequence: Synthetic oligonucleotide"
ccagugguguuagccgggc

SEQ ID NO: 9649 - RNA, 19 nt, Artificial Sequence
  source: /note="Description of Artificial Sequence: Synthetic oligonucleotide"
uauagucgagccaagcaga

SEQ ID NO: 9650 - RNA, 19 nt, Artificial Sequence
  source: /note="Description of Artificial Sequence: Synthetic oligonucleotide"
ucugcuuggcucgacuaua

SEQ ID NO: 9651 - RNA, 19 nt, Artificial Sequence
  source: /note="Description of Artificial Sequence: Synthetic oligonucleotide"
cacgaaagugauuggaaau

SEQ ID NO: 9652 - RNA, 19 nt, Artificial Sequence
  source: /note="Description of Artificial Sequence: Synthetic oligonucleotide"
auuuccaaucacuuucgug

SEQ ID NO: 9653 - RNA, 19 nt, Artificial Sequence
  source: /note="Description of Artificial Sequence: Synthetic oligonucleotide"
aggacaagcgauuuaagaa

SEQ ID NO: 9654 - RNA, 19 nt, Artificial Sequence
  source: /note="Description of Artificial Sequence: Synthetic oligonucleotide"
uucuuaaaucgcuuguccu

SEQ ID NO: 9655 - RNA, 19 nt, Artificial Sequence
  source: /note="Description of Artificial Sequence: Synthetic oligonucleotide"
gcgaccgagaaccaccucc

SEQ ID NO: 9656 - RNA, 19 nt, Artificial Sequence
  source: /note="Description of Artificial Sequence: Synthetic oligonucleotide"
ggaggugguucucggucgc

SEQ ID NO: 9657 - RNA, 19 nt, Artificial Sequence
  source: /note="Description of Artificial Sequence: Synthetic oligonucleotide"
aggucuaccuuaaccuggu

SEQ ID NO: 9658 - RNA, 19 nt, Artificial Sequence
  source: /note="Description of Artificial Sequence: Synthetic oligonucleotide"
accagguuaagguagaccu

SEQ ID NO: 9659 - RNA, 19 nt, Artificial Sequence
  source: /note="Description of Artificial Sequence: Synthetic oligonucleotide"
ccggagacaguguacagag

SEQ ID NO: 9660 - RNA, 19 nt, Artificial Sequence
  source: /note="Description of Artificial Sequence: Synthetic oligonucleotide"
cucuguacacugucuccgg

SEQ ID NO: 9661 - RNA, 19 nt, Artificial Sequence
  source: /note="Description of Artificial Sequence: Synthetic oligonucleotide"
agucgagccaagcagacac

SEQ ID NO: 9662 - RNA, 19 nt, Artificial Sequence
  source: /note="Description of Artificial Sequence: Synthetic oligonucleotide"
gugucugcuuggcucgacu

SEQ ID NO: 9663 - RNA, 19 nt, Artificial Sequence
  source: /note="Description of Artificial Sequence: Synthetic oligonucleotide"
cugccaucgagacauuaaa

SEQ ID NO: 9664 - RNA, 19 nt, Artificial Sequence
  source: /note="Description of Artificial Sequence: Synthetic oligonucleotide"
uuuaaugucucgauggcag

SEQ ID NO: 9665 - RNA, 19 nt, Artificial Sequence
  source: /note="Description of Artificial Sequence: Synthetic oligonucleotide"
agagcccaauguuucauau

SEQ ID NO: 9666 - RNA, 19 nt, Artificial Sequence
  source: /note="Description of Artificial Sequence: Synthetic oligonucleotide"
auaugaaacauugggcucu

SEQ ID NO: 9667 - RNA, 19 nt, Artificial Sequence
  source: /note="Description of Artificial Sequence: Synthetic oligonucleotide"
ucgguacuacagggcacca

SEQ ID NO: 9668 - RNA, 19 nt, Artificial Sequence
  source: /note="Description of Artificial Sequence: Synthetic oligonucleotide"
uggugcccuguaguaccga

SEQ ID NO: 9669 - RNA, 19 nt, Artificial Sequence
  source: /note="Description of Artificial Sequence: Synthetic oligonucleotide"
aauaauaaagguccuagga

SEQ ID NO: 9670 - RNA, 19 nt, Artificial Sequence
  source: /note="Description of Artificial Sequence: Synthetic oligonucleotide"
uccuaggaccuuuauuauu

SEQ ID NO: 9671 - RNA, 19 nt, Artificial Sequence
  source: /note="Description of Artificial Sequence: Synthetic oligonucleotide"
gagcaaauuagagaaauga

SEQ ID NO: 9672 - RNA, 19 nt, Artificial Sequence
  source: /note="Description of Artificial Sequence: Synthetic oligonucleotide"
ucauuucucuaauuugcuc

SEQ ID NO: 9673 - RNA, 19 nt, Artificial Sequence
  source: /note="Description of Artificial Sequence: Synthetic oligonucleotide"
uaccgcccggcuaacacca

SEQ ID NO: 9674 - RNA, 19 nt, Artificial Sequence
  source: /note="Description of Artificial Sequence: Synthetic oligonucleotide"
ugguguuagccgggcggua

SEQ ID NO: 9675 - RNA, 19 nt, Artificial Sequence
  source: /note="Description of Artificial Sequence: Synthetic oligonucleotide"
augucggggcgaccgagaa

SEQ ID NO: 9676 - RNA, 19 nt, Artificial Sequence
  source: /note="Description of Artificial Sequence: Synthetic oligonucleotide"
uucucggucgccccgacau

SEQ ID NO: 9677 - RNA, 19 nt, Artificial Sequence
  source: /note="Description of Artificial Sequence: Synthetic oligonucleotide"
cgaccgagaaccaccuccu

SEQ ID NO: 9678 - RNA, 19 nt, Artificial Sequence
  source: /note="Description of Artificial Sequence: Synthetic oligonucleotide"
aggaggugguucucggucg

SEQ ID NO: 9679 - RNA, 19 nt, Artificial Sequence
  source: /note="Description of Artificial Sequence: Synthetic oligonucleotide"
uuugcggagagcugcaagc

SEQ ID NO: 9680 - RNA, 19 nt, Artificial Sequence
  source: /note="Description of Artificial Sequence: Synthetic oligonucleotide"
gcuugcagcucuccgcaaa

SEQ ID NO: 9681 - RNA, 19 nt, Artificial Sequence
  source: /note="Description of Artificial Sequence: Synthetic oligonucleotide"
agcaagguaaccacaguag

SEQ ID NO: 9682 - RNA, 19 nt, Artificial Sequence
  source: /note="Description of Artificial Sequence: Synthetic oligonucleotide"
cuacugugguuaccuugcu

SEQ ID NO: 9683 - RNA, 19 nt, Artificial Sequence
  source: /note="Description of Artificial Sequence: Synthetic oligonucleotide"
gguaaccacaguaguggca

SEQ ID NO: 9684 - RNA, 19 nt, Artificial Sequence
  source: /note="Description of Artificial Sequence: Synthetic oligonucleotide"
ugccacuacugugguuacc

SEQ ID NO: 9685 - RNA, 19 nt, Artificial Sequence
  source: /note="Description of Artificial Sequence: Synthetic oligonucleotide"
gaagucaguuauacagaca

SEQ ID NO: 9686 - RNA, 19 nt, Artificial Sequence
  source: /note="Description of Artificial Sequence: Synthetic oligonucleotide"
ugucuguauaacugacuuc

SEQ ID NO: 9687 - RNA, 19 nt, Artificial Sequence
  source: /note="Description of Artificial Sequence: Synthetic oligonucleotide"
agucaguuauacagacacg

SEQ ID NO: 9688 - RNA, 19 nt, Artificial Sequence
  source: /note="Description of Artificial Sequence: Synthetic oligonucleotide"
cgugucuguauaacugacu

SEQ ID NO: 9689 - RNA, 19 nt, Artificial Sequence
  source: /note="Description of Artificial Sequence: Synthetic oligonucleotide"
acacgaaagugauuggaaa

SEQ ID NO: 9690 - RNA, 19 nt, Artificial Sequence
  source: /note="Description of Artificial Sequence: Synthetic oligonucleotide"
uuuccaaucacuuucgugu

SEQ ID NO: 9691 - RNA, 19 nt, Artificial Sequence
  source: /note="Description of Artificial Sequence: Synthetic oligonucleotide"
acgaaagugauuggaaaug

SEQ ID NO: 9692 - RNA, 19 nt, Artificial Sequence
  source: /note="Description of Artificial Sequence: Synthetic oligonucleotide"
cauuuccaaucacuuucgu

SEQ ID NO: 9693 - RNA, 19 nt, Artificial Sequence
  source: /note="Description of Artificial Sequence: Synthetic oligonucleotide"
aaagugauuggaaauggau

SEQ ID NO: 9694 - RNA, 19 nt, Artificial Sequence
  source: /note="Description of Artificial Sequence: Synthetic oligonucleotide"
auccauuuccaaucacuuu

SEQ ID NO: 9695 - RNA, 19 nt, Artificial Sequence
  source: /note="Description of Artificial Sequence: Synthetic oligonucleotide"
auaucaagccaaacuuugu

SEQ ID NO: 9696 - RNA, 19 nt, Artificial Sequence
  source: /note="Description of Artificial Sequence: Synthetic oligonucleotide"
acaaaguuuggcuugauau

SEQ ID NO: 9697 - RNA, 19 nt, Artificial Sequence
  source: /note="Description of Artificial Sequence: Synthetic oligonucleotide"
agccaaacuuugugauucu

SEQ ID NO: 9698 - RNA, 19 nt, Artificial Sequence
  source: /note="Description of Artificial Sequence: Synthetic oligonucleotide"
agaaucacaaaguuuggcu

SEQ ID NO: 9699 - RNA, 19 nt, Artificial Sequence
  source: /note="Description of Artificial Sequence: Synthetic oligonucleotide"
ccaucaagaaaguucuaca

SEQ ID NO: 9700 - RNA, 19 nt, Artificial Sequence
  source: /note="Description of Artificial Sequence: Synthetic oligonucleotide"
uguagaacuuucuugaugg

SEQ ID NO: 9701 - RNA, 19 nt, Artificial Sequence
  source: /note="Description of Artificial Sequence: Synthetic oligonucleotide"
caucaagaaaguucuacag

SEQ ID NO: 9702 - RNA, 19 nt, Artificial Sequence
  source: /note="Description of Artificial Sequence: Synthetic oligonucleotide"
cuguagaacuuucuugaug

SEQ ID NO: 9703 - RNA, 19 nt, Artificial Sequence
  source: /note="Description of Artificial Sequence: Synthetic oligonucleotide"
guucuacaggacaagcgau

SEQ ID NO: 9704 - RNA, 19 nt, Artificial Sequence
  source: /note="Description of Artificial Sequence: Synthetic oligonucleotide"
aucgcuuguccuguagaac

SEQ ID NO: 9705 - RNA, 19 nt, Artificial Sequence
  source: /note="Description of Artificial Sequence: Synthetic oligonucleotide"
aucaugagaaagcuagacc

SEQ ID NO: 9706 - RNA, 19 nt, Artificial Sequence
  source: /note="Description of Artificial Sequence: Synthetic oligonucleotide"
ggucuagcuuucucaugau

SEQ ID NO: 9707 - RNA, 19 nt, Artificial Sequence
  source: /note="Description of Artificial Sequence: Synthetic oligonucleotide"
uucuucuacucgaguggug

SEQ ID NO: 9708 - RNA, 19 nt, Artificial Sequence
  source: /note="Description of Artificial Sequence: Synthetic oligonucleotide"
caccacucgaguagaagaa

SEQ ID NO: 9709 - RNA, 19 nt, Artificial Sequence
  source: /note="Description of Artificial Sequence: Synthetic oligonucleotide"
cucgaguggugagaagaaa

SEQ ID NO: 9710 - RNA, 19 nt, Artificial Sequence
  source: /note="Description of Artificial Sequence: Synthetic oligonucleotide"
uuucuucucaccacucgag

SEQ ID NO: 9711 - RNA, 19 nt, Artificial Sequence
  source: /note="Description of Artificial Sequence: Synthetic oligonucleotide"
cuuaaccuggugcuggacu

SEQ ID NO: 9712 - RNA, 19 nt, Artificial Sequence
  source: /note="Description of Artificial Sequence: Synthetic oligonucleotide"
aguccagcaccagguuaag

SEQ ID NO: 9713 - RNA, 19 nt, Artificial Sequence
  source: /note="Description of Artificial Sequence: Synthetic oligonucleotide"
aaccuggugcuggacuaug

SEQ ID NO: 9714 - RNA, 19 nt, Artificial Sequence
  source: /note="Description of Artificial Sequence: Synthetic oligonucleotide"
cauaguccagcaccagguu

SEQ ID NO: 9715 - RNA, 19 nt, Artificial Sequence
  source: /note="Description of Artificial Sequence: Synthetic oligonucleotide"
uccggagacaguguacaga

SEQ ID NO: 9716 - RNA, 19 nt, Artificial Sequence
  source: /note="Description of Artificial Sequence: Synthetic oligonucleotide"
ucuguacacugucuccgga

SEQ ID NO: 9717 - RNA, 19 nt, Artificial Sequence
  source: /note="Description of Artificial Sequence: Synthetic oligonucleotide"
aguguacagagucgccaga

SEQ ID NO: 9718 - RNA, 19 nt, Artificial Sequence
  source: /note="Description of Artificial Sequence: Synthetic oligonucleotide"
ucuggcgacucuguacacu

SEQ ID NO: 9719 - RNA, 19 nt, Artificial Sequence
  source: /note="Description of Artificial Sequence: Synthetic oligonucleotide"
guguacagagucgccagac

SEQ ID NO: 9720 - RNA, 19 nt, Artificial Sequence
  source: /note="Description of Artificial Sequence: Synthetic oligonucleotide"
gucuggcgacucuguacac

SEQ ID NO: 9721 - RNA, 19 nt, Artificial Sequence
  source: /note="Description of Artificial Sequence: Synthetic oligonucleotide"
uacagagucgccagacacu

SEQ ID NO: 9722 - RNA, 19 nt, Artificial Sequence
  source: /note="Description of Artificial Sequence: Synthetic oligonucleotide"
agugucuggcgacucugua

SEQ ID NO: 9723 - RNA, 19 nt, Artificial Sequence
  source: /note="Description of Artificial Sequence: Synthetic oligonucleotide"
agagucgccagacacuaua

SEQ ID NO: 9724 - RNA, 19 nt, Artificial Sequence
  source: /note="Description of Artificial Sequence: Synthetic oligonucleotide"
uauagugucuggcgacucu

SEQ ID NO: 9725 - RNA, 19 nt, Artificial Sequence
  source: /note="Description of Artificial Sequence: Synthetic oligonucleotide"
agucgccagacacuauagu

SEQ ID NO: 9726 - RNA, 19 nt, Artificial Sequence
  source: /note="Description of Artificial Sequence: Synthetic oligonucleotide"
acuauagugucuggcgacu

SEQ ID NO: 9727 - RNA, 19 nt, Artificial Sequence
  source: /note="Description of Artificial Sequence: Synthetic oligonucleotide"
uagucgagccaagcagaca

SEQ ID NO: 9728 - RNA, 19 nt, Artificial Sequence
  source: /note="Description of Artificial Sequence: Synthetic oligonucleotide"
ugucugcuuggcucgacua

SEQ ID NO: 9729 - RNA, 19 nt, Artificial Sequence
  source: /note="Description of Artificial Sequence: Synthetic oligonucleotide"
ugugaucuaugucaaguug

SEQ ID NO: 9730 - RNA, 19 nt, Artificial Sequence
  source: /note="Description of Artificial Sequence: Synthetic oligonucleotide"
caacuugacauagaucaca

SEQ ID NO: 9731 - RNA, 19 nt, Artificial Sequence
  source: /note="Description of Artificial Sequence: Synthetic oligonucleotide"
aucuaugucaaguuguaua

SEQ ID NO: 9732 - RNA, 19 nt, Artificial Sequence
  source: /note="Description of Artificial Sequence: Synthetic oligonucleotide"
uauacaacuugacauagau

SEQ ID NO: 9733 - RNA, 19 nt, Artificial Sequence
  source: /note="Description of Artificial Sequence: Synthetic oligonucleotide"
ucuaugucaaguuguauau

SEQ ID NO: 9734 - RNA, 19 nt, Artificial Sequence
  source: /note="Description of Artificial Sequence: Synthetic oligonucleotide"
auauacaacuugacauaga

SEQ ID NO: 9735 - RNA, 19 nt, Artificial Sequence
  source: /note="Description of Artificial Sequence: Synthetic oligonucleotide"
aaguuguauauguaucagc

SEQ ID NO: 9736 - RNA, 19 nt, Artificial Sequence
  source: /note="Description of Artificial Sequence: Synthetic oligonucleotide"
gcugauacauauacaacuu

SEQ ID NO: 9737 - RNA, 19 nt, Artificial Sequence
  source: /note="Description of Artificial Sequence: Synthetic oligonucleotide"
aguuguauauguaucagcu

SEQ ID NO: 9738 - RNA, 19 nt, Artificial Sequence
  source: /note="Description of Artificial Sequence: Synthetic oligonucleotide"
agcugauacauauacaacu

SEQ ID NO: 9739 - RNA, 19 nt, Artificial Sequence
  source: /note="Description of Artificial Sequence: Synthetic oligonucleotide"
uguauauguaucagcuguu

SEQ ID NO: 9740 - RNA, 19 nt, Artificial Sequence
  source: /note="Description of Artificial Sequence: Synthetic oligonucleotide"
aacagcugauacauauaca

SEQ ID NO: 9741 - RNA, 19 nt, Artificial Sequence
  source: /note="Description of Artificial Sequence: Synthetic oligonucleotide"
auauguaucagcuguucag

SEQ ID NO: 9742 - RNA, 19 nt, Artificial Sequence
  source: /note="Description of Artificial Sequence: Synthetic oligonucleotide"
cugaacagcugauacauau

SEQ ID NO: 9743 - RNA, 19 nt, Artificial Sequence
  source: /note="Description of Artificial Sequence: Synthetic oligonucleotide"
uuuggaaucugccaucgag

SEQ ID NO: 9744 - RNA, 19 nt, Artificial Sequence
  source: /note="Description of Artificial Sequence: Synthetic oligonucleotide"
cucgauggcagauuccaaa

SEQ ID NO: 9745 - RNA, 19 nt, Artificial Sequence
  source: /note="Description of Artificial Sequence: Synthetic oligonucleotide"
auacagcuguauuaaaacu

SEQ ID NO: 9746 - RNA, 19 nt, Artificial Sequence
  source: /note="Description of Artificial Sequence: Synthetic oligonucleotide"
aguuuuaauacagcuguau

SEQ ID NO: 9747 - RNA, 19 nt, Artificial Sequence
  source: /note="Description of Artificial Sequence: Synthetic oligonucleotide"
uguauuaaaacucugugac

SEQ ID NO: 9748 - RNA, 19 nt, Artificial Sequence
  source: /note="Description of Artificial Sequence: Synthetic oligonucleotide"
gucacagaguuuuaauaca

SEQ ID NO: 9749 - RNA, 19 nt, Artificial Sequence
  source: /note="Description of Artificial Sequence: Synthetic oligonucleotide"
gaggagagcccaauguuuc

SEQ ID NO: 9750 - RNA, 19 nt, Artificial Sequence
  source: /note="Description of Artificial Sequence: Synthetic oligonucleotide"
gaaacauugggcucuccuc

SEQ ID NO: 9751 - RNA, 19 nt, Artificial Sequence
  source: /note="Description of Artificial Sequence: Synthetic oligonucleotide"
gcccaauguuucauauauc

SEQ ID NO: 9752 - RNA, 19 nt, Artificial Sequence
  source: /note="Description of Artificial Sequence: Synthetic oligonucleotide"
gauauaugaaacauugggc

SEQ ID NO: 9753 - RNA, 19 nt, Artificial Sequence
  source: /note="Description of Artificial Sequence: Synthetic oligonucleotide"
uuucauauaucuguucucg

SEQ ID NO: 9754 - RNA, 19 nt, Artificial Sequence
  source: /note="Description of Artificial Sequence: Synthetic oligonucleotide"
cgagaacagauauaugaaa

SEQ ID NO: 9755 - RNA, 19 nt, Artificial Sequence
  source: /note="Description of Artificial Sequence: Synthetic oligonucleotide"
auaucuguucucgguacua

SEQ ID NO: 9756 - RNA, 19 nt, Artificial Sequence
  source: /note="Description of Artificial Sequence: Synthetic oligonucleotide"
uaguaccgagaacagauau

SEQ ID NO: 9757 - RNA, 19 nt, Artificial Sequence
  source: /note="Description of Artificial Sequence: Synthetic oligonucleotide"
cgguacuacagggcaccag

SEQ ID NO: 9758 - RNA, 19 nt, Artificial Sequence
  source: /note="Description of Artificial Sequence: Synthetic oligonucleotide"
cuggugcccuguaguaccg

SEQ ID NO: 9759 - RNA, 19 nt, Artificial Sequence
  source: /note="Description of Artificial Sequence: Synthetic oligonucleotide"
ccaguauagauguaugguc

SEQ ID NO: 9760 - RNA, 19 nt, Artificial Sequence
  source: /note="Description of Artificial Sequence: Synthetic oligonucleotide"
gaccauacaucuauacugg

SEQ ID NO: 9761 - RNA, 19 nt, Artificial Sequence
  source: /note="Description of Artificial Sequence: Synthetic oligonucleotide"
uuguugcuaggacaaccaa

SEQ ID NO: 9762 - RNA, 19 nt, Artificial Sequence
  source: /note="Description of Artificial Sequence: Synthetic oligonucleotide"
uugguuguccuagcaacaa

SEQ ID NO: 9763 - RNA, 19 nt, Artificial Sequence
  source: /note="Description of Artificial Sequence: Synthetic oligonucleotide"
uguugcuaggacaaccaau

SEQ ID NO: 9764 - RNA, 19 nt, Artificial Sequence
  source: /note="Description of Artificial Sequence: Synthetic oligonucleotide"
auugguuguccuagcaaca

SEQ ID NO: 9765 - RNA, 19 nt, Artificial Sequence
  source: /note="Description of Artificial Sequence: Synthetic oligonucleotide"
caguugguggaaauaauaa

SEQ ID NO: 9766 - RNA, 19 nt, Artificial Sequence
  source: /note="Description of Artificial Sequence: Synthetic oligonucleotide"
uuauuauuuccaccaacug

SEQ ID NO: 9767 - RNA, 19 nt, Artificial Sequence
  source: /note="Description of Artificial Sequence: Synthetic oligonucleotide"
agcaaauuagagaaaugaa

SEQ ID NO: 9768 - RNA, 19 nt, Artificial Sequence
  source: /note="Description of Artificial Sequence: Synthetic oligonucleotide"
uucauuucucuaauuugcu

SEQ ID NO: 9769 - RNA, 19 nt, Artificial Sequence
  source: /note="Description of Artificial Sequence: Synthetic oligonucleotide"
cccaaauuauacagaauuc

SEQ ID NO: 9770 - RNA, 19 nt, Artificial Sequence
  source: /note="Description of Artificial Sequence: Synthetic oligonucleotide"
gaauucuguauaauuuggg

SEQ ID NO: 9771 - RNA, 19 nt, Artificial Sequence
  source: /note="Description of Artificial Sequence: Synthetic oligonucleotide"
aauucccucaaaucaaggc

SEQ ID NO: 9772 - RNA, 19 nt, Artificial Sequence
  source: /note="Description of Artificial Sequence: Synthetic oligonucleotide"
gccuugauuugagggaauu

SEQ ID NO: 9773 - RNA, 19 nt, Artificial Sequence
  source: /note="Description of Artificial Sequence: Synthetic oligonucleotide"
aaaucaaggcacauccuug

SEQ ID NO: 9774 - RNA, 19 nt, Artificial Sequence
  source: /note="Description of Artificial Sequence: Synthetic oligonucleotide"
caaggaugugccuugauuu

SEQ ID NO: 9775 - RNA, 19 nt, Artificial Sequence
  source: /note="Description of Artificial Sequence: Synthetic oligonucleotide"
cccgaacuccaccagaggc

SEQ ID NO: 9776 - RNA, 19 nt, Artificial Sequence
  source: /note="Description of Artificial Sequence: Synthetic oligonucleotide"
gccucugguggaguucggg

SEQ ID NO: 9777 - RNA, 19 nt, Artificial Sequence
  source: /note="Description of Artificial Sequence: Synthetic oligonucleotide"
ccgucugcuggaguacaca

SEQ ID NO: 9778 - RNA, 19 nt, Artificial Sequence
  source: /note="Description of Artificial Sequence: Synthetic oligonucleotide"
uguguacuccagcagacgg

SEQ ID NO: 9779 - RNA, 19 nt, Artificial Sequence
  source: /note="Description of Artificial Sequence: Synthetic oligonucleotide"
gaguacacaccuaccgccc

SEQ ID NO: 9780 - RNA, 19 nt, Artificial Sequence
  source: /note="Description of Artificial Sequence: Synthetic oligonucleotide"
gggcgguagguguguacuc

SEQ ID NO: 9781 - RNA, 19 nt, Artificial Sequence
  source: /note="Description of Artificial Sequence: Synthetic oligonucleotide"
ccagaucaugagaaagcua

SEQ ID NO: 9782 - RNA, 19 nt, Artificial Sequence
  source: /note="Description of Artificial Sequence: Synthetic oligonucleotide"
uagcuuucucaugaucugg

SEQ ID NO: 9783 - RNA, 19 nt, Artificial Sequence
  source: /note="Description of Artificial Sequence: Synthetic oligonucleotide"
cuagccuauauccauuccu

SEQ ID NO: 9784 - RNA, 19 nt, Artificial Sequence
  source: /note="Description of Artificial Sequence: Synthetic oligonucleotide"
aggaauggauauaggcuag

SEQ ID NO: 9785 - RNA, 19 nt, Artificial Sequence
  source: /note="Description of Artificial Sequence: Synthetic oligonucleotide"
gagagcccaauguuucaua

SEQ ID NO: 9786 - RNA, 19 nt, Artificial Sequence
  source: /note="Description of Artificial Sequence: Synthetic oligonucleotide"
uaugaaacauugggcucuc

SEQ ID NO: 9787 - RNA, 19 nt, Artificial Sequence
  source: /note="Description of Artificial Sequence: Synthetic oligonucleotide"
gguacuacagggcaccaga

SEQ ID NO: 9788 - RNA, 19 nt, Artificial Sequence
  source: /note="Description of Artificial Sequence: Synthetic oligonucleotide"
ucuggugcccuguaguacc

SEQ ID NO: 9789 - RNA, 19 nt, Artificial Sequence
  source: /note="Description of Artificial Sequence: Synthetic oligonucleotide"
acagggcaccagaguugau

SEQ ID NO: 9790 - RNA, 19 nt, Artificial Sequence
  source: /note="Description of Artificial Sequence: Synthetic oligonucleotide"
aucaacucuggugcccugu

SEQ ID NO: 9791 - RNA, 19 nt, Artificial Sequence
  source: /note="Description of Artificial Sequence: Synthetic oligonucleotide"
ggaucaguugguggaaaua

SEQ ID NO: 9792 - RNA, 19 nt, Artificial Sequence
  source: /note="Description of Artificial Sequence: Synthetic oligonucleotide"
uauuuccaccaacugaucc

SEQ ID NO: 9793 - RNA, 19 nt, Artificial Sequence
  source: /note="Description of Artificial Sequence: Synthetic oligonucleotide"
gacaaaggucuuccggccc

SEQ ID NO: 9794 - RNA, 19 nt, Artificial Sequence
  source: /note="Description of Artificial Sequence: Synthetic oligonucleotide"
gggccggaagaccuuuguc

SEQ ID NO: 9795 - RNA, 19 nt, Artificial Sequence
  source: /note="Description of Artificial Sequence: Synthetic oligonucleotide"
cuggugcuggacuauguuc

SEQ ID NO: 9796 - RNA, 19 nt, Artificial Sequence
  source: /note="Description of Artificial Sequence: Synthetic oligonucleotide"
gaacauaguccagcaccag

SEQ ID NO: 9797 - RNA, 19 nt, Artificial Sequence
  source: /note="Description of Artificial Sequence: Synthetic oligonucleotide"
cggggcgaccgagaaccac

SEQ ID NO: 9798 - RNA, 19 nt, Artificial Sequence
  source: /note="Description of Artificial Sequence: Synthetic oligonucleotide"
gugguucucggucgccccg

SEQ ID NO: 9799 - RNA, 19 nt, Artificial Sequence
  source: /note="Description of Artificial Sequence: Synthetic oligonucleotide"
cuccuuugcggagagcugc

SEQ ID NO: 9800 - RNA, 19 nt, Artificial Sequence
  source: /note="Description of Artificial Sequence: Synthetic oligonucleotide"
gcagcucuccgcaaaggag

SEQ ID NO: 9801 - RNA, 19 nt, Artificial Sequence
  source: /note="Description of Artificial Sequence: Synthetic oligonucleotide"
uccuuugcggagagcugca

SEQ ID NO: 9802 - RNA, 19 nt, Artificial Sequence
  source: /note="Description of Artificial Sequence: Synthetic oligonucleotide"
ugcagcucuccgcaaagga

SEQ ID NO: 9803 - RNA, 19 nt, Artificial Sequence
  source: /note="Description of Artificial Sequence: Synthetic oligonucleotide"
agcagagauaaagauggca

SEQ ID NO: 9804 - RNA, 19 nt, Artificial Sequence
  source: /note="Description of Artificial Sequence: Synthetic oligonucleotide"
ugccaucuuuaucucugcu

SEQ ID NO: 9805 - RNA, 19 nt, Artificial Sequence
  source: /note="Description of Artificial Sequence: Synthetic oligonucleotide"
aguaguggcaacuccuggc

SEQ ID NO: 9806 - RNA, 19 nt, Artificial Sequence
  source: /note="Description of Artificial Sequence: Synthetic oligonucleotide"
gccaggaguugccacuacu

SEQ ID NO: 9807 - RNA, 19 nt, Artificial Sequence
  source: /note="Description of Artificial Sequence: Synthetic oligonucleotide"
guaguggcaacuccuggcc

SEQ ID NO: 9808 - RNA, 19 nt, Artificial Sequence
  source: /note="Description of Artificial Sequence: Synthetic oligonucleotide"
ggccaggaguugccacuac

SEQ ID NO: 9809 - RNA, 19 nt, Artificial Sequence
  source: /note="Description of Artificial Sequence: Synthetic oligonucleotide"
agacacgaaagugauugga

SEQ ID NO: 9810 - RNA, 19 nt, Artificial Sequence
  source: /note="Description of Artificial Sequence: Synthetic oligonucleotide"
uccaaucacuuucgugucu

SEQ ID NO: 9811 - RNA, 19 nt, Artificial Sequence
  source: /note="Description of Artificial Sequence: Synthetic oligonucleotide"
aagugauuggaaauggauc

SEQ ID NO: 9812 - RNA, 19 nt, Artificial Sequence
  source: /note="Description of Artificial Sequence: Synthetic oligonucleotide"
gauccauuuccaaucacuu

SEQ ID NO: 9813 - RNA, 19 nt, Artificial Sequence
  source: /note="Description of Artificial Sequence: Synthetic oligonucleotide"
gaucauuuggugugguaua

SEQ ID NO: 9814 - RNA, 19 nt, Artificial Sequence
  source: /note="Description of Artificial Sequence: Synthetic oligonucleotide"
uauaccacaccaaaugauc

SEQ ID NO: 9815 - RNA, 19 nt, Artificial Sequence
  source: /note="Description of Artificial Sequence: Synthetic oligonucleotide"
gugugguauaucaagccaa

SEQ ID NO: 9816 - RNA, 19 nt, Artificial Sequence
  source: /note="Description of Artificial Sequence: Synthetic oligonucleotide"
uuggcuugauauaccacac

SEQ ID NO: 9817 - RNA, 19 nt, Artificial Sequence
  source: /note="Description of Artificial Sequence: Synthetic oligonucleotide"
ugguauaucaagccaaacu

SEQ ID NO: 9818 - RNA, 19 nt, Artificial Sequence
  source: /note="Description of Artificial Sequence: Synthetic oligonucleotide"
aguuuggcuugauauacca

SEQ ID NO: 9819 - RNA, 19 nt, Artificial Sequence
  source: /note="Description of Artificial Sequence: Synthetic oligonucleotide"
gguauaucaagccaaacuu

SEQ ID NO: 9820 - RNA, 19 nt, Artificial Sequence
  source: /note="Description of Artificial Sequence: Synthetic oligonucleotide"
aaguuuggcuugauauacc

SEQ ID NO: 9821 - RNA, 19 nt, Artificial Sequence
  source: /note="Description of Artificial Sequence: Synthetic oligonucleotide"
guauaucaagccaaacuuu

SEQ ID NO: 9822 - RNA, 19 nt, Artificial Sequence
  source: /note="Description of Artificial Sequence: Synthetic oligonucleotide"
aaaguuuggcuugauauac

SEQ ID NO: 9823 - RNA, 19 nt, Artificial Sequence
  source: /note="Description of Artificial Sequence: Synthetic oligonucleotide"
gguugccaucaagaaaguu

SEQ ID NO: 9824 - RNA, 19 nt, Artificial Sequence
  source: /note="Description of Artificial Sequence: Synthetic oligonucleotide"
aacuuucuugauggcaacc

SEQ ID NO: 9825 - RNA, 19 nt, Artificial Sequence
  source: /note="Description of Artificial Sequence: Synthetic oligonucleotide"
gauuuaagaaccgagagcu

SEQ ID NO: 9826 - RNA, 19 nt, Artificial Sequence
  source: /note="Description of Artificial Sequence: Synthetic oligonucleotide"
agcucucgguucuuaaauc

SEQ ID NO: 9827 - RNA, 19 nt, Artificial Sequence
  source: /note="Description of Artificial Sequence: Synthetic oligonucleotide"
uuuaagaaccgagagcucc

SEQ ID NO: 9828 - RNA, 19 nt, Artificial Sequence
  source: /note="Description of Artificial Sequence: Synthetic oligonucleotide"
ggagcucucgguucuuaaa

SEQ ID NO: 9829 - RNA, 19 nt, Artificial Sequence
  source: /note="Description of Artificial Sequence: Synthetic oligonucleotide"
agaucaugagaaagcuaga

SEQ ID NO: 9830 - RNA, 19 nt, Artificial Sequence
  source: /note="Description of Artificial Sequence: Synthetic oligonucleotide"
ucuagcuuucucaugaucu

SEQ ID NO: 9831 - RNA, 19 nt, Artificial Sequence
  source: /note="Description of Artificial Sequence: Synthetic oligonucleotide"
gaaagcuagaccacuguaa

SEQ ID NO: 9832 - RNA, 19 nt, Artificial Sequence
  source: /note="Description of Artificial Sequence: Synthetic oligonucleotide"
uuacaguggucuagcuuuc

SEQ ID NO: 9833 - RNA, 19 nt, Artificial Sequence
  source: /note="Description of Artificial Sequence: Synthetic oligonucleotide"
aaagcuagaccacuguaac

SEQ ID NO: 9834 - RNA, 19 nt, Artificial Sequence
  source: /note="Description of Artificial Sequence: Synthetic oligonucleotide"
guuacaguggucuagcuuu

SEQ ID NO: 9835 - RNA, 19 nt, Artificial Sequence
  source: /note="Description of Artificial Sequence: Synthetic oligonucleotide"
cgacugcgguauuucuucu

SEQ ID NO: 9836 - RNA, 19 nt, Artificial Sequence
  source: /note="Description of Artificial Sequence: Synthetic oligonucleotide"
agaagaaauaccgcagucg

SEQ ID NO: 9837 - RNA, 19 nt, Artificial Sequence
  source: /note="Description of Artificial Sequence: Synthetic oligonucleotide"
gacugcgguauuucuucua

SEQ ID NO: 9838 - RNA, 19 nt, Artificial Sequence
  source: /note="Description of Artificial Sequence: Synthetic oligonucleotide"
uagaagaaauaccgcaguc

SEQ ID NO: 9839 - RNA, 19 nt, Artificial Sequence
  source: /note="Description of Artificial Sequence: Synthetic oligonucleotide"
acucgaguggugagaagaa

SEQ ID NO: 9840 - RNA, 19 nt, Artificial Sequence
  source: /note="Description of Artificial Sequence: Synthetic oligonucleotide"
uucuucucaccacucgagu

SEQ ID NO: 9841 - RNA, 19 nt, Artificial Sequence
  source: /note="Description of Artificial Sequence: Synthetic oligonucleotide"
ucgaguggugagaagaaag

SEQ ID NO: 9842 - RNA, 19 nt, Artificial Sequence
  source: /note="Description of Artificial Sequence: Synthetic oligonucleotide"
cuuucuucucaccacucga

SEQ ID NO: 9843 - RNA, 19 nt, Artificial Sequence
  source: /note="Description of Artificial Sequence: Synthetic oligonucleotide"
ugaggucuaccuuaaccug

SEQ ID NO: 9844 - RNA, 19 nt, Artificial Sequence
  source: /note="Description of Artificial Sequence: Synthetic oligonucleotide"
cagguuaagguagaccuca

SEQ ID NO: 9845 - RNA, 19 nt, Artificial Sequence
  source: /note="Description of Artificial Sequence: Synthetic oligonucleotide"
uuaaccuggugcuggacua

SEQ ID NO: 9846 - RNA, 19 nt, Artificial Sequence
  source: /note="Description of Artificial Sequence: Synthetic oligonucleotide"
uaguccagcaccagguuaa

SEQ ID NO: 9847 - RNA, 19 nt, Artificial Sequence
  source: /note="Description of Artificial Sequence: Synthetic oligonucleotide"
acuauguuccggagacagu

SEQ ID NO: 9848 - RNA, 19 nt, Artificial Sequence
  source: /note="Description of Artificial Sequence: Synthetic oligonucleotide"
acugucuccggaacauagu

SEQ ID NO: 9849 - RNA, 19 nt, Artificial Sequence
  source: /note="Description of Artificial Sequence: Synthetic oligonucleotide"
guuccggagacaguguaca

SEQ ID NO: 9850 - RNA, 19 nt, Artificial Sequence
  source: /note="Description of Artificial Sequence: Synthetic oligonucleotide"
uguacacugucuccggaac

SEQ ID NO: 9851 - RNA, 19 nt, Artificial Sequence
  source: /note="Description of Artificial Sequence: Synthetic oligonucleotide"
gagacaguguacagagucg

SEQ ID NO: 9852 - RNA, 19 nt, Artificial Sequence
  source: /note="Description of Artificial Sequence: Synthetic oligonucleotide"
cgacucuguacacugucuc

SEQ ID NO: 9853 - RNA, 19 nt, Artificial Sequence
  source: /note="Description of Artificial Sequence: Synthetic oligonucleotide"
cgccagacacuauagucga

SEQ ID NO: 9854 - RNA, 19 nt, Artificial Sequence
  source: /note="Description of Artificial Sequence: Synthetic oligonucleotide"
ucgacuauagugucuggcg

SEQ ID NO: 9855 - RNA, 19 nt, Artificial Sequence
  source: /note="Description of Artificial Sequence: Synthetic oligonucleotide"
acucccugugaucuauguc

SEQ ID NO: 9856 - RNA, 19 nt, Artificial Sequence
  source: /note="Description of Artificial Sequence: Synthetic oligonucleotide"
gacauagaucacagggagu

SEQ ID NO: 9857 - RNA, 19 nt, Artificial Sequence
  source: /note="Description of Artificial Sequence: Synthetic oligonucleotide"
ucccugugaucuaugucaa

SEQ ID NO: 9858 - RNA, 19 nt, Artificial Sequence
  source: /note="Description of Artificial Sequence: Synthetic oligonucleotide"
uugacauagaucacaggga

SEQ ID NO: 9859 - RNA, 19 nt, Artificial Sequence
  source: /note="Description of Artificial Sequence: Synthetic oligonucleotide"
uaugucaaguuguauaugu

SEQ ID NO: 9860 - RNA, 19 nt, Artificial Sequence
  source: /note="Description of Artificial Sequence: Synthetic oligonucleotide"
acauauacaacuugacaua

SEQ ID NO: 9861 - RNA, 19 nt, Artificial Sequence
  source: /note="Description of Artificial Sequence: Synthetic oligonucleotide"
uuguauauguaucagcugu

SEQ ID NO: 9862 - RNA, 19 nt, Artificial Sequence
  source: /note="Description of Artificial Sequence: Synthetic oligonucleotide"
acagcugauacauauacaa

SEQ ID NO: 9863 - RNA, 19 nt, Artificial Sequence
  source: /note="Description of Artificial Sequence: Synthetic oligonucleotide"
acauuaaaccacagaaccu

SEQ ID NO: 9864 - RNA, 19 nt, Artificial Sequence
  source: /note="Description of Artificial Sequence: Synthetic oligonucleotide"
agguucugugguuuaaugu

SEQ ID NO: 9865 - RNA, 19 nt, Artificial Sequence
  source: /note="Description of Artificial Sequence: Synthetic oligonucleotide"
acagaaccucuuguuggau

SEQ ID NO: 9866 - RNA, 19 nt, Artificial Sequence
  source: /note="Description of Artificial Sequence: Synthetic oligonucleotide"
auccaacaagagguucugu

SEQ ID NO: 9867 - RNA, 19 nt, Artificial Sequence
  source: /note="Description of Artificial Sequence: Synthetic oligonucleotide"
agaaccucuuguuggaucc

SEQ ID NO: 9868 - RNA, 19 nt, Artificial Sequence
  source: /note="Description of Artificial Sequence: Synthetic oligonucleotide"
ggauccaacaagagguucu

SEQ ID NO: 9869 - RNA, 19 nt, Artificial Sequence
  source: /note="Description of Artificial Sequence: Synthetic oligonucleotide"
uuguuggauccugauacag

SEQ ID NO: 9870 - RNA, 19 nt, Artificial Sequence
  source: /note="Description of Artificial Sequence: Synthetic oligonucleotide"
cuguaucaggauccaacaa

SEQ ID NO: 9871 - RNA, 19 nt, Artificial Sequence
  source: /note="Description of Artificial Sequence: Synthetic oligonucleotide"
gauccugauacagcuguau

SEQ ID NO: 9872 - RNA, 19 nt, Artificial Sequence
  source: /note="Description of Artificial Sequence: Synthetic oligonucleotide"
auacagcuguaucaggauc

SEQ ID NO: 9873 - RNA, 19 nt, Artificial Sequence
  source: /note="Description of Artificial Sequence: Synthetic oligonucleotide"
gauacagcuguauuaaaac

SEQ ID NO: 9874 - RNA, 19 nt, Artificial Sequence
  source: /note="Description of Artificial Sequence: Synthetic oligonucleotide"
guuuuaauacagcuguauc

SEQ ID NO: 9875 - RNA, 19 nt, Artificial Sequence
  source: /note="Description of Artificial Sequence: Synthetic oligonucleotide"
gcaaagcagcugguccgag

SEQ ID NO: 9876 - RNA, 19 nt, Artificial Sequence
  source: /note="Description of Artificial Sequence: Synthetic oligonucleotide"
cucggaccagcugcuuugc

SEQ ID NO: 9877 - RNA, 19 nt, Artificial Sequence
  source: /note="Description of Artificial Sequence: Synthetic oligonucleotide"
cgaggagagcccaauguuu

SEQ ID NO: 9878 - RNA, 19 nt, Artificial Sequence
  source: /note="Description of Artificial Sequence: Synthetic oligonucleotide"
aaacauugggcucuccucg

SEQ ID NO: 9879 - RNA, 19 nt, Artificial Sequence
  source: /note="Description of Artificial Sequence: Synthetic oligonucleotide"
agcccaauguuucauauau

SEQ ID NO: 9880 - RNA, 19 nt, Artificial Sequence
  source: /note="Description of Artificial Sequence: Synthetic oligonucleotide"
auauaugaaacauugggcu

SEQ ID NO: 9881 - RNA, 19 nt, Artificial Sequence
  source: /note="Description of Artificial Sequence: Synthetic oligonucleotide"
ccagaguugaucuuuggag

SEQ ID NO: 9882 - RNA, 19 nt, Artificial Sequence
  source: /note="Description of Artificial Sequence: Synthetic oligonucleotide"
cuccaaagaucaacucugg

SEQ ID NO: 9883 - RNA, 19 nt, Artificial Sequence
  source: /note="Description of Artificial Sequence: Synthetic oligonucleotide"
cagaguugaucuuuggagc

SEQ ID NO: 9884 - RNA, 19 nt, Artificial Sequence
  source: /note="Description of Artificial Sequence: Synthetic oligonucleotide"
gcuccaaagaucaacucug

SEQ ID NO: 9885 - RNA, 19 nt, Artificial Sequence
  source: /note="Description of Artificial Sequence: Synthetic oligonucleotide"
gccacugauuacacgucca

SEQ ID NO: 9886 - RNA, 19 nt, Artificial Sequence
  source: /note="Description of Artificial Sequence: Synthetic oligonucleotide"
uggacguguaaucaguggc

SEQ ID NO: 9887 - RNA, 19 nt, Artificial Sequence
  source: /note="Description of Artificial Sequence: Synthetic oligonucleotide"
auagauguauggucugcag

SEQ ID NO: 9888 - RNA, 19 nt, Artificial Sequence
  source: /note="Description of Artificial Sequence: Synthetic oligonucleotide"
cugcagaccauacaucuau

SEQ ID NO: 9889 - RNA, 19 nt, Artificial Sequence
  source: /note="Description of Artificial Sequence: Synthetic oligonucleotide"
guauggucugcaggcugug

SEQ ID NO: 9890 - RNA, 19 nt, Artificial Sequence
  source: /note="Description of Artificial Sequence: Synthetic oligonucleotide"
cacagccugcagaccauac

SEQ ID NO: 9891 - RNA, 19 nt, Artificial Sequence
  source: /note="Description of Artificial Sequence: Synthetic oligonucleotide"
auuguugcuaggacaacca

SEQ ID NO: 9892 - RNA, 19 nt, Artificial Sequence
  source: /note="Description of Artificial Sequence: Synthetic oligonucleotide"
ugguuguccuagcaacaau

SEQ ID NO: 9893 - RNA, 19 nt, Artificial Sequence
  source: /note="Description of Artificial Sequence: Synthetic oligonucleotide"
gacaaccaauauuuccugg

SEQ ID NO: 9894 - RNA, 19 nt, Artificial Sequence
  source: /note="Description of Artificial Sequence: Synthetic oligonucleotide"
ccaggaaauauugguuguc

SEQ ID NO: 9895 - RNA, 19 nt, Artificial Sequence
  source: /note="Description of Artificial Sequence: Synthetic oligonucleotide"
auauuuccuggggacagug

SEQ ID NO: 9896 - RNA, 19 nt, Artificial Sequence
  source: /note="Description of Artificial Sequence: Synthetic oligonucleotide"
cacuguccccaggaaauau

SEQ ID NO: 9897 - RNA, 19 nt, Artificial Sequence
  source: /note="Description of Artificial Sequence: Synthetic oligonucleotide"
uguggaucaguugguggaa

SEQ ID NO: 9898 - RNA, 19 nt, Artificial Sequence
  source: /note="Description of Artificial Sequence: Synthetic oligonucleotide"
uuccaccaacugauccaca

SEQ ID NO: 9899 - RNA, 19 nt, Artificial Sequence
  source: /note="Description of Artificial Sequence: Synthetic oligonucleotide"
aacaagggagcaaauuaga

SEQ ID NO: 9900 - RNA, 19 nt, Artificial Sequence
  source: /note="Description of Artificial Sequence: Synthetic oligonucleotide"
ucuaauuugcucccuuguu

SEQ ID NO: 9901 - RNA, 19 nt, Artificial Sequence
  source: /note="Description of Artificial Sequence: Synthetic oligonucleotide"
ggagcaaauuagagaaaug

SEQ ID NO: 9902 - RNA, 19 nt, Artificial Sequence
  source: /note="Description of Artificial Sequence: Synthetic oligonucleotide"
cauuucucuaauuugcucc

SEQ ID NO: 9903 - RNA, 19 nt, Artificial Sequence
  source: /note="Description of Artificial Sequence: Synthetic oligonucleotide"
acccaaauuauacagaauu

SEQ ID NO: 9904 - RNA, 19 nt, Artificial Sequence
  source: /note="Description of Artificial Sequence: Synthetic oligonucleotide"
aauucuguauaauuugggu

SEQ ID NO: 9905 - RNA, 19 nt, Artificial Sequence
  source: /note="Description of Artificial Sequence: Synthetic oligonucleotide"
caaaucaaggcacauccuu

SEQ ID NO: 9906 - RNA, 19 nt, Artificial Sequence
  source: /note="Description of Artificial Sequence: Synthetic oligonucleotide"
aaggaugugccuugauuug

SEQ ID NO: 9907 - RNA, 19 nt, Artificial Sequence
  source: /note="Description of Artificial Sequence: Synthetic oligonucleotide"
ucaaggcacauccuuggac

SEQ ID NO: 9908 - RNA, 19 nt, Artificial Sequence
  source: /note="Description of Artificial Sequence: Synthetic oligonucleotide"
guccaaggaugugccuuga

SEQ ID NO: 9909 - RNA, 19 nt, Artificial Sequence
  source: /note="Description of Artificial Sequence: Synthetic oligonucleotide"
uuccggccccgaacuccac

SEQ ID NO: 9910 - RNA, 19 nt, Artificial Sequence
  source: /note="Description of Artificial Sequence: Synthetic oligonucleotide"
guggaguucggggccggaa

SEQ ID NO: 9911 - RNA, 19 nt, Artificial Sequence
  source: /note="Description of Artificial Sequence: Synthetic oligonucleotide"
cagccgucugcuggaguac

SEQ ID NO: 9912 - RNA, 19 nt, Artificial Sequence
  source: /note="Description of Artificial Sequence: Synthetic oligonucleotide"
guacuccagcagacggcug

SEQ ID NO: 9913 - RNA, 19 nt, Artificial Sequence
  source: /note="Description of Artificial Sequence: Synthetic oligonucleotide"
agccgucugcuggaguaca

SEQ ID NO: 9914 - RNA, 19 nt, Artificial Sequence
  source: /note="Description of Artificial Sequence: Synthetic oligonucleotide"
uguacuccagcagacggcu

SEQ ID NO: 9915 - RNA, 19 nt, Artificial Sequence
  source: /note="Description of Artificial Sequence: Synthetic oligonucleotide"
gccgucugcuggaguacac

SEQ ID NO: 9916 - RNA, 19 nt, Artificial Sequence
  source: /note="Description of Artificial Sequence: Synthetic oligonucleotide"
guguacuccagcagacggc

SEQ ID NO: 9917 - RNA, 19 nt, Artificial Sequence
  source: /note="Description of Artificial Sequence: Synthetic oligonucleotide"
ugcuggaguacacaccuac

SEQ ID NO: 9918 - RNA, 19 nt, Artificial Sequence
  source: /note="Description of Artificial Sequence: Synthetic oligonucleotide"
guagguguguacuccagca

SEQ ID NO: 9919 - RNA, 19 nt, Artificial Sequence
  source: /note="Description of Artificial Sequence: Synthetic oligonucleotide"
ugucggggcgaccgagaac

SEQ ID NO: 9920 - RNA, 19 nt, Artificial Sequence
  source: /note="Description of Artificial Sequence: Synthetic oligonucleotide"
guucucggucgccccgaca

SEQ ID NO: 9921 - RNA, 19 nt, Artificial Sequence
  source: /note="Description of Artificial Sequence: Synthetic oligonucleotide"
ggggcgaccgagaaccacc

SEQ ID NO: 9922 - RNA, 19 nt, Artificial Sequence
  source: /note="Description of Artificial Sequence: Synthetic oligonucleotide"
ggugguucucggucgcccc

SEQ ID NO: 9923 - RNA, 19 nt, Artificial Sequence
  source: /note="Description of Artificial Sequence: Synthetic oligonucleotide"
gaccgagaaccaccuccuu

SEQ ID NO: 9924 - RNA, 19 nt, Artificial Sequence
  source: /note="Description of Artificial Sequence: Synthetic oligonucleotide"
aaggaggugguucucgguc

SEQ ID NO: 9925 - RNA, 19 nt, Artificial Sequence
  source: /note="Description of Artificial Sequence: Synthetic oligonucleotide"
gaaccaccuccuuugcgga

SEQ ID NO: 9926 - RNA, 19 nt, Artificial Sequence
  source: /note="Description of Artificial Sequence: Synthetic oligonucleotide"
uccgcaaaggaggugguuc

SEQ ID NO: 9927 - RNA, 19 nt, Artificial Sequence
  source: /note="Description of Artificial Sequence: Synthetic oligonucleotide"
cuuugcggagagcugcaag

SEQ ID NO: 9928 - RNA, 19 nt, Artificial Sequence
  source: /note="Description of Artificial Sequence: Synthetic oligonucleotide"
cuugcagcucuccgcaaag

SEQ ID NO: 9929 - RNA, 19 nt, Artificial Sequence
  source: /note="Description of Artificial Sequence: Synthetic oligonucleotide"
gcggagagcugcaagccag

SEQ ID NO: 9930 - RNA, 19 nt, Artificial Sequence
  source: /note="Description of Artificial Sequence: Synthetic oligonucleotide"
cuggcuugcagcucuccgc

SEQ ID NO: 9931 - RNA, 19 nt, Artificial Sequence
  source: /note="Description of Artificial Sequence: Synthetic oligonucleotide"
cugcaagccagugcagcag

SEQ ID NO: 9932 - RNA, 19 nt, Artificial Sequence
  source: /note="Description of Artificial Sequence: Synthetic oligonucleotide"
cugcugcacuggcuugcag

SEQ ID NO: 9933 - RNA, 19 nt, Artificial Sequence
  source: /note="Description of Artificial Sequence: Synthetic oligonucleotide"
cagugcagcagccuucagc

SEQ ID NO: 9934 - RNA, 19 nt, Artificial Sequence
  source: /note="Description of Artificial Sequence: Synthetic oligonucleotide"
gcugaaggcugcugcacug

SEQ ID NO: 9935 - RNA, 19 nt, Artificial Sequence
  source: /note="Description of Artificial Sequence: Synthetic oligonucleotide"
agcagccuucagcuuuugg

SEQ ID NO: 9936 - RNA, 19 nt, Artificial Sequence
  source: /note="Description of Artificial Sequence: Synthetic oligonucleotide"
ccaaaagcugaaggcugcu

SEQ ID NO: 9937 - RNA, 19 nt, Artificial Sequence
  source: /note="Description of Artificial Sequence: Synthetic oligonucleotide"
gcagccuucagcuuuuggu

SEQ ID NO: 9938 - RNA, 19 nt, Artificial Sequence
  source: /note="Description of Artificial Sequence: Synthetic oligonucleotide"
accaaaagcugaaggcugc

SEQ ID NO: 9939 - RNA, 19 nt, Artificial Sequence
  source: /note="Description of Artificial Sequence: Synthetic oligonucleotide"
agccuucagcuuuugguag

SEQ ID NO: 9940 - RNA, 19 nt, Artificial Sequence
  source: /note="Description of Artificial Sequence: Synthetic oligonucleotide"
cuaccaaaagcugaaggcu

SEQ ID NO: 9941 - RNA, 19 nt, Artificial Sequence
  source: /note="Description of Artificial Sequence: Synthetic oligonucleotide"
gccuucagcuuuugguagc

SEQ ID NO: 9942 - RNA, 19 nt, Artificial Sequence
  source: /note="Description of Artificial Sequence: Synthetic oligonucleotide"
gcuaccaaaagcugaaggc

SEQ ID NO: 9943 - RNA, 19 nt, Artificial Sequence
  source: /note="Description of Artificial Sequence: Synthetic oligonucleotide"
uucagcuuuugguagcaug

SEQ ID NO: 9944 - RNA, 19 nt, Artificial Sequence
  source: /note="Description of Artificial Sequence: Synthetic oligonucleotide"
caugcuaccaaaagcugaa

SEQ ID NO: 9945 - RNA, 19 nt, Artificial Sequence
  source: /note="Description of Artificial Sequence: Synthetic oligonucleotide"
cagcuuuugguagcaugaa

SEQ ID NO: 9946 - RNA, 19 nt, Artificial Sequence
  source: /note="Description of Artificial Sequence: Synthetic oligonucleotide"
uucaugcuaccaaaagcug

SEQ ID NO: 9947 - RNA, 19 nt, Artificial Sequence
  source: /note="Description of Artificial Sequence: Synthetic oligonucleotide"
agcuuuugguagcaugaaa

SEQ ID NO: 9948 - RNA, 19 nt, Artificial Sequence
  source: /note="Description of Artificial Sequence: Synthetic oligonucleotide"
uuucaugcuaccaaaagcu

SEQ ID NO: 9949 - RNA, 19 nt, Artificial Sequence
  source: /note="Description of Artificial Sequence: Synthetic oligonucleotide"
agcaugaaaguuagcagag

SEQ ID NO: 9950 - RNA, 19 nt, Artificial Sequence
  source: /note="Description of Artificial Sequence: Synthetic oligonucleotide"
cucugcuaacuuucaugcu

SEQ ID NO: 9951 - RNA, 19 nt, Artificial Sequence
  source: /note="Description of Artificial Sequence: Synthetic oligonucleotide"
ugaaaguuagcagagauaa

SEQ ID NO: 9952 - RNA, 19 nt, Artificial Sequence
  source: /note="Description of Artificial Sequence: Synthetic oligonucleotide"
uuaucucugcuaacuuuca

SEQ ID NO: 9953 - RNA, 19 nt, Artificial Sequence
  source: /note="Description of Artificial Sequence: Synthetic oligonucleotide"
uaaagauggcagcaaggua

SEQ ID NO: 9954 - RNA, 19 nt, Artificial Sequence
  source: /note="Description of Artificial Sequence: Synthetic oligonucleotide"
uaccuugcugccaucuuua

SEQ ID NO: 9955 - RNA, 19 nt, Artificial Sequence
  source: /note="Description of Artificial Sequence: Synthetic oligonucleotide"
aaagauggcagcaagguaa

SEQ ID NO: 9956 - RNA, 19 nt, Artificial Sequence
  source: /note="Description of Artificial Sequence: Synthetic oligonucleotide"
uuaccuugcugccaucuuu

SEQ ID NO: 9957 - RNA, 19 nt, Artificial Sequence
  source: /note="Description of Artificial Sequence: Synthetic oligonucleotide"
ggcagcaagguaaccacag

SEQ ID NO: 9958 - RNA, 19 nt, Artificial Sequence
  source: /note="Description of Artificial Sequence: Synthetic oligonucleotide"
cugugguuaccuugcugcc

SEQ ID NO: 9959 - RNA, 19 nt, Artificial Sequence
  source: /note="Description of Artificial Sequence: Synthetic oligonucleotide"
cagcaagguaaccacagua

SEQ ID NO: 9960 - RNA, 19 nt, Artificial Sequence
  source: /note="Description of Artificial Sequence: Synthetic oligonucleotide"
uacugugguuaccuugcug

SEQ ID NO: 9961 - RNA, 19 nt, Artificial Sequence
  source: /note="Description of Artificial Sequence: Synthetic oligonucleotide"
aaccacaguaguggcaacu

SEQ ID NO: 9962 - RNA, 19 nt, Artificial Sequence
  source: /note="Description of Artificial Sequence: Synthetic oligonucleotide"
aguugccacuacugugguu

SEQ ID NO: 9963 - RNA, 19 nt, Artificial Sequence
  source: /note="Description of Artificial Sequence: Synthetic oligonucleotide"
accacaguaguggcaacuc

SEQ ID NO: 9964 - RNA, 19 nt, Artificial Sequence
  source: /note="Description of Artificial Sequence: Synthetic oligonucleotide"
gaguugccacuacuguggu

SEQ ID NO: 9965 - RNA, 19 nt, Artificial Sequence
  source: /note="Description of Artificial Sequence: Synthetic oligonucleotide"
guggcaacuccuggccagg

SEQ ID NO: 9966 - RNA, 19 nt, Artificial Sequence
  source: /note="Description of Artificial Sequence: Synthetic oligonucleotide"
ccuggccaggaguugccac

SEQ ID NO: 9967 - RNA, 19 nt, Artificial Sequence
  source: /note="Description of Artificial Sequence: Synthetic oligonucleotide"
ggcaacuccuggccagggu

SEQ ID NO: 9968 - RNA, 19 nt, Artificial Sequence
  source: /note="Description of Artificial Sequence: Synthetic oligonucleotide"
acccuggccaggaguugcc

SEQ ID NO: 9969 - RNA, 19 nt, Artificial Sequence
  source: /note="Description of Artificial Sequence: Synthetic oligonucleotide"
gcaacuccuggccaggguc

SEQ ID NO: 9970 - RNA, 19 nt, Artificial Sequence
  source: /note="Description of Artificial Sequence: Synthetic oligonucleotide"
gacccuggccaggaguugc

SEQ ID NO: 9971 - RNA, 19 nt, Artificial Sequence
  source: /note="Description of Artificial Sequence: Synthetic oligonucleotide"
aacuccuggccaggguccu

SEQ ID NO: 9972 - RNA, 19 nt, Artificial Sequence
  source: /note="Description of Artificial Sequence: Synthetic oligonucleotide"
aggacccuggccaggaguu

SEQ ID NO: 9973 - RNA, 19 nt, Artificial Sequence
  source: /note="Description of Artificial Sequence: Synthetic oligonucleotide"
uccugacaggccacaggaa

SEQ ID NO: 9974 - RNA, 19 nt, Artificial Sequence
  source: /note="Description of Artificial Sequence: Synthetic oligonucleotide"
uuccuguggccugucagga

SEQ ID NO: 9975 - RNA, 19 nt, Artificial Sequence
  source: /note="Description of Artificial Sequence: Synthetic oligonucleotide"
ccugacaggccacaggaag

SEQ ID NO: 9976 - RNA, 19 nt, Artificial Sequence
  source: /note="Description of Artificial Sequence: Synthetic oligonucleotide"
cuuccuguggccugucagg

SEQ ID NO: 9977 - RNA, 19 nt, Artificial Sequence
  source: /note="Description of Artificial Sequence: Synthetic oligonucleotide"
ugacaggccacaggaaguc

SEQ ID NO: 9978 - RNA, 19 nt, Artificial Sequence
  source: /note="Description of Artificial Sequence: Synthetic oligonucleotide"
gacuuccuguggccuguca

SEQ ID NO: 9979 - RNA, 19 nt, Artificial Sequence
  source: /note="Description of Artificial Sequence: Synthetic oligonucleotide"
gacaggccacaggaaguca

SEQ ID NO: 9980 - RNA, 19 nt, Artificial Sequence
  source: /note="Description of Artificial Sequence: Synthetic oligonucleotide"
ugacuuccuguggccuguc

SEQ ID NO: 9981 - RNA, 19 nt, Artificial Sequence
  source: /note="Description of Artificial Sequence: Synthetic oligonucleotide"
gucaguuauacagacacga

SEQ ID NO: 9982 - RNA, 19 nt, Artificial Sequence
  source: /note="Description of Artificial Sequence: Synthetic oligonucleotide"
ucgugucuguauaacugac

SEQ ID NO: 9983 - RNA, 19 nt, Artificial Sequence
  source: /note="Description of Artificial Sequence: Synthetic oligonucleotide"
caguuauacagacacgaaa

SEQ ID NO: 9984 - RNA, 19 nt, Artificial Sequence
  source: /note="Description of Artificial Sequence: Synthetic oligonucleotide"
uuucgugucuguauaacug

SEQ ID NO: 9985 - RNA, 19 nt, Artificial Sequence
  source: /note="Description of Artificial Sequence: Synthetic oligonucleotide"
guuauacagacacgaaagu

SEQ ID NO: 9986 - RNA, 19 nt, Artificial Sequence
  source: /note="Description of Artificial Sequence: Synthetic oligonucleotide"
acuuucgugucuguauaac

SEQ ID NO: 9987 - RNA, 19 nt, Artificial Sequence
  source: /note="Description of Artificial Sequence: Synthetic oligonucleotide"
uauacagacacgaaaguga

SEQ ID NO: 9988 - RNA, 19 nt, Artificial Sequence
  source: /note="Description of Artificial Sequence: Synthetic oligonucleotide"
ucacuuucgugucuguaua

SEQ ID NO: 9989 - RNA, 19 nt, Artificial Sequence
  source: /note="Description of Artificial Sequence: Synthetic oligonucleotide"
uacagacacgaaagugauu

SEQ ID NO: 9990 - RNA, 19 nt, Artificial Sequence
  source: /note="Description of Artificial Sequence: Synthetic oligonucleotide"
aaucacuuucgugucugua

SEQ ID NO: 9991 - RNA, 19 nt, Artificial Sequence
  source: /note="Description of Artificial Sequence: Synthetic oligonucleotide"
cgaaagugauuggaaaugg

SEQ ID NO: 9992 - RNA, 19 nt, Artificial Sequence
  source: /note="Description of Artificial Sequence: Synthetic oligonucleotide"
ccauuuccaaucacuuucg

SEQ ID NO: 9993 - RNA, 19 nt, Artificial Sequence
  source: /note="Description of Artificial Sequence: Synthetic oligonucleotide"
ugauuggaaauggaucauu

SEQ ID NO: 9994 - RNA, 19 nt, Artificial Sequence
  source: /note="Description of Artificial Sequence: Synthetic oligonucleotide"
aaugauccauuuccaauca

SEQ ID NO: 9995 - RNA, 19 nt, Artificial Sequence
  source: /note="Description of Artificial Sequence: Synthetic oligonucleotide"
uggaucauuugguguggua

SEQ ID NO: 9996 - RNA, 19 nt, Artificial Sequence
  source: /note="Description of Artificial Sequence: Synthetic oligonucleotide"
uaccacaccaaaugaucca

SEQ ID NO: 9997 - RNA, 19 nt, Artificial Sequence
  source: /note="Description of Artificial Sequence: Synthetic oligonucleotide"
ucauuuggugugguauauc

SEQ ID NO: 9998 - RNA, 19 nt, Artificial Sequence
  source: /note="Description of Artificial Sequence: Synthetic oligonucleotide"
gauauaccacaccaaauga

SEQ ID NO: 9999 - RNA, 19 nt, Artificial Sequence
  source: /note="Description of Artificial Sequence: Synthetic oligonucleotide"
ugugguauaucaagccaaa

SEQ ID NO: 10000 - RNA, 19 nt, Artificial Sequence
  source: /note="Description of Artificial Sequence: Synthetic oligonucleotide"
uuuggcuugauauaccaca

SEQ ID NO: 10001 - RNA, 19 nt, Artificial Sequence
  source: /note="Description of Artificial Sequence: Synthetic oligonucleotide"
uauaucaagccaaacuuug

SEQ ID NO: 10002 - RNA, 19 nt, Artificial Sequence
  source: /note="Description of Artificial Sequence: Synthetic oligonucleotide"
caaaguuuggcuugauaua

SEQ ID NO: 10003 - RNA, 19 nt, Artificial Sequence
  source: /note="Description of Artificial Sequence: Synthetic oligonucleotide"
uaucaagccaaacuuugug

SEQ ID NO: 10004 - RNA, 19 nt, Artificial Sequence
  source: /note="Description of Artificial Sequence: Synthetic oligonucleotide"
cacaaaguuuggcuugaua

SEQ ID NO: 10005 - RNA, 19 nt, Artificial Sequence
  source: /note="Description of Artificial Sequence: Synthetic oligonucleotide"
aucaagccaaacuuuguga

SEQ ID NO: 10006 - RNA, 19 nt, Artificial Sequence
  source: /note="Description of Artificial Sequence: Synthetic oligonucleotide"
ucacaaaguuuggcuugau

SEQ ID NO: 10007 - RNA, 19 nt, Artificial Sequence
  source: /note="Description of Artificial Sequence: Synthetic oligonucleotide"
uuugugauucuggagaacu

SEQ ID NO: 10008 - RNA, 19 nt, Artificial Sequence
  source: /note="Description of Artificial Sequence: Synthetic oligonucleotide"
aguucuccagaaucacaaa

SEQ ID NO: 10009 - RNA, 19 nt, Artificial Sequence
  source: /note="Description of Artificial Sequence: Synthetic oligonucleotide"
uggagaacugguugccauc

SEQ ID NO: 10010 - RNA, 19 nt, Artificial Sequence
  source: /note="Description of Artificial Sequence: Synthetic oligonucleotide"
gauggcaaccaguucucca

SEQ ID NO: 10011 - RNA, 19 nt, Artificial Sequence
  source: /note="Description of Artificial Sequence: Synthetic oligonucleotide"
ggagaacugguugccauca

SEQ ID NO: 10012 - RNA, 19 nt, Artificial Sequence
  source: /note="Description of Artificial Sequence: Synthetic oligonucleotide"
ugauggcaaccaguucucc

SEQ ID NO: 10013 - RNA, 19 nt, Artificial Sequence
  source: /note="Description of Artificial Sequence: Synthetic oligonucleotide"
ugguugccaucaagaaagu

SEQ ID NO: 10014 - RNA, 19 nt, Artificial Sequence
  source: /note="Description of Artificial Sequence: Synthetic oligonucleotide"
acuuucuugauggcaacca

SEQ ID NO: 10015 - RNA, 19 nt, Artificial Sequence
  source: /note="Description of Artificial Sequence: Synthetic oligonucleotide"
guugccaucaagaaaguuc

SEQ ID NO: 10016 - RNA, 19 nt, Artificial Sequence
  source: /note="Description of Artificial Sequence: Synthetic oligonucleotide"
gaacuuucuugauggcaac

SEQ ID NO: 10017 - RNA, 19 nt, Artificial Sequence
  source: /note="Description of Artificial Sequence: Synthetic oligonucleotide"
uugccaucaagaaaguucu

SEQ ID NO: 10018 - RNA, 19 nt, Artificial Sequence
  source: /note="Description of Artificial Sequence: Synthetic oligonucleotide"
agaacuuucuugauggcaa

SEQ ID NO: 10019 - RNA, 19 nt, Artificial Sequence
  source: /note="Description of Artificial Sequence: Synthetic oligonucleotide"
aucaagaaaguucuacagg

SEQ ID NO: 10020 - RNA, 19 nt, Artificial Sequence
  source: /note="Description of Artificial Sequence: Synthetic oligonucleotide"
ccuguagaacuuucuugau

SEQ ID NO: 10021 - RNA, 19 nt, Artificial Sequence
  source: /note="Description of Artificial Sequence: Synthetic oligonucleotide"
aguucuacaggacaagcga

SEQ ID NO: 10022 - RNA, 19 nt, Artificial Sequence
  source: /note="Description of Artificial Sequence: Synthetic oligonucleotide"
ucgcuuguccuguagaacu

SEQ ID NO: 10023 - RNA, 19 nt, Artificial Sequence
  source: /note="Description of Artificial Sequence: Synthetic oligonucleotide"
cuacaggacaagcgauuua

SEQ ID NO: 10024 - RNA, 19 nt, Artificial Sequence
  source: /note="Description of Artificial Sequence: Synthetic oligonucleotide"
uaaaucgcuuguccuguag

SEQ ID NO: 10025 - RNA, 19 nt, Artificial Sequence
  source: /note="Description of Artificial Sequence: Synthetic oligonucleotide"
agaaccgagagcuccagau

SEQ ID NO: 10026 - RNA, 19 nt, Artificial Sequence
  source: /note="Description of Artificial Sequence: Synthetic oligonucleotide"
aucuggagcucucgguucu

SEQ ID NO: 10027 - RNA, 19 nt, Artificial Sequence
  source: /note="Description of Artificial Sequence: Synthetic oligonucleotide"
ccgagagcuccagaucaug

SEQ ID NO: 10028 - RNA, 19 nt, Artificial Sequence
  source: /note="Description of Artificial Sequence: Synthetic oligonucleotide"
caugaucuggagcucucgg

SEQ ID NO: 10029 - RNA, 19 nt, Artificial Sequence
  source: /note="Description of Artificial Sequence: Synthetic oligonucleotide"
agcuccagaucaugagaaa

SEQ ID NO: 10030 - RNA, 19 nt, Artificial Sequence
  source: /note="Description of Artificial Sequence: Synthetic oligonucleotide"
uuucucaugaucuggagcu

SEQ ID NO: 10031 - RNA, 19 nt, Artificial Sequence
  source: /note="Description of Artificial Sequence: Synthetic oligonucleotide"
gcuccagaucaugagaaag

SEQ ID NO: 10032 - RNA, 19 nt, Artificial Sequence
  source: /note="Description of Artificial Sequence: Synthetic oligonucleotide"
cuuucucaugaucuggagc

SEQ ID NO: 10033 - RNA, 19 nt, Artificial Sequence
  source: /note="Description of Artificial Sequence: Synthetic oligonucleotide"
cuccagaucaugagaaagc

SEQ ID NO: 10034 - RNA, 19 nt, Artificial Sequence
  source: /note="Description of Artificial Sequence: Synthetic oligonucleotide"
gcuuucucaugaucuggag

SEQ ID NO: 10035 - RNA, 19 nt, Artificial Sequence
  source: /note="Description of Artificial Sequence: Synthetic oligonucleotide"
cagaucaugagaaagcuag

SEQ ID NO: 10036 - RNA, 19 nt, Artificial Sequence
  source: /note="Description of Artificial Sequence: Synthetic oligonucleotide"
cuagcuuucucaugaucug

SEQ ID NO: 10037 - RNA, 19 nt, Artificial Sequence
  source: /note="Description of Artificial Sequence: Synthetic oligonucleotide"
ucaugagaaagcuagacca

SEQ ID NO: 10038 - RNA, 19 nt, Artificial Sequence
  source: /note="Description of Artificial Sequence: Synthetic oligonucleotide"
uggucuagcuuucucauga

SEQ ID NO: 10039 - RNA, 19 nt, Artificial Sequence
  source: /note="Description of Artificial Sequence: Synthetic oligonucleotide"
caugagaaagcuagaccac

SEQ ID NO: 10040 - RNA, 19 nt, Artificial Sequence
  source: /note="Description of Artificial Sequence: Synthetic oligonucleotide"
guggucuagcuuucucaug

SEQ ID NO: 10041 - RNA, 19 nt, Artificial Sequence
  source: /note="Description of Artificial Sequence: Synthetic oligonucleotide"
augagaaagcuagaccacu

SEQ ID NO: 10042 - RNA, 19 nt, Artificial Sequence
  source: /note="Description of Artificial Sequence: Synthetic oligonucleotide"
aguggucuagcuuucucau

SEQ ID NO: 10043 - RNA, 19 nt, Artificial Sequence
  source: /note="Description of Artificial Sequence: Synthetic oligonucleotide"
acugcgguauuucuucuac

SEQ ID NO: 10044 - RNA, 19 nt, Artificial Sequence
  source: /note="Description of Artificial Sequence: Synthetic oligonucleotide"
guagaagaaauaccgcagu

SEQ ID NO: 10045 - RNA, 19 nt, Artificial Sequence
  source: /note="Description of Artificial Sequence: Synthetic oligonucleotide"
auuucuucuacucgagugg

SEQ ID NO: 10046 - RNA, 19 nt, Artificial Sequence
  source: /note="Description of Artificial Sequence: Synthetic oligonucleotide"
ccacucgaguagaagaaau

SEQ ID NO: 10047 - RNA, 19 nt, Artificial Sequence
  source: /note="Description of Artificial Sequence: Synthetic oligonucleotide"
ucuucuacucgagugguga

SEQ ID NO: 10048 - RNA, 19 nt, Artificial Sequence
  source: /note="Description of Artificial Sequence: Synthetic oligonucleotide"
ucaccacucgaguagaaga

SEQ ID NO: 10049 - RNA, 19 nt, Artificial Sequence
  source: /note="Description of Artificial Sequence: Synthetic oligonucleotide"
cgaguggugagaagaaaga

SEQ ID NO: 10050 - RNA, 19 nt, Artificial Sequence
  source: /note="Description of Artificial Sequence: Synthetic oligonucleotide"
ucuuucuucucaccacucg

SEQ ID NO: 10051 - RNA, 19 nt, Artificial Sequence
  source: /note="Description of Artificial Sequence: Synthetic oligonucleotide"
agaaagaugaggucuaccu

SEQ ID NO: 10052 - RNA, 19 nt, Artificial Sequence
  source: /note="Description of Artificial Sequence: Synthetic oligonucleotide"
agguagaccucaucuuucu

SEQ ID NO: 10053 - RNA, 19 nt, Artificial Sequence
  source: /note="Description of Artificial Sequence: Synthetic oligonucleotide"
gaaagaugaggucuaccuu

SEQ ID NO: 10054 - RNA, 19 nt, Artificial Sequence
  source: /note="Description of Artificial Sequence: Synthetic oligonucleotide"
aagguagaccucaucuuuc

SEQ ID NO: 10055 - RNA, 19 nt, Artificial Sequence
  source: /note="Description of Artificial Sequence: Synthetic oligonucleotide"
gaggucuaccuuaaccugg

SEQ ID NO: 10056 - RNA, 19 nt, Artificial Sequence
  source: /note="Description of Artificial Sequence: Synthetic oligonucleotide"
ccagguuaagguagaccuc

SEQ ID NO: 10057 - RNA, 19 nt, Artificial Sequence
  source: /note="Description of Artificial Sequence: Synthetic oligonucleotide"
cuaccuuaaccuggugcug

SEQ ID NO: 10058 - RNA, 19 nt, Artificial Sequence
  source: /note="Description of Artificial Sequence: Synthetic oligonucleotide"
cagcaccagguuaagguag

SEQ ID NO: 10059 - RNA, 19 nt, Artificial Sequence
  source: /note="Description of Artificial Sequence: Synthetic oligonucleotide"
accuggugcuggacuaugu

SEQ ID NO: 10060 - RNA, 19 nt, Artificial Sequence
  source: /note="Description of Artificial Sequence: Synthetic oligonucleotide"
acauaguccagcaccaggu

SEQ ID NO: 10061 - RNA, 19 nt, Artificial Sequence
  source: /note="Description of Artificial Sequence: Synthetic oligonucleotide"
ccuggugcuggacuauguu

SEQ ID NO: 10062 - RNA, 19 nt, Artificial Sequence
  source: /note="Description of Artificial Sequence: Synthetic oligonucleotide"
aacauaguccagcaccagg

SEQ ID NO: 10063 - RNA, 19 nt, Artificial Sequence
  source: /note="Description of Artificial Sequence: Synthetic oligonucleotide"
ggugcuggacuauguuccg

SEQ ID NO: 10064 - RNA, 19 nt, Artificial Sequence
  source: /note="Description of Artificial Sequence: Synthetic oligonucleotide"
cggaacauaguccagcacc

SEQ ID NO: 10065 - RNA, 19 nt, Artificial Sequence
  source: /note="Description of Artificial Sequence: Synthetic oligonucleotide"
uuccggagacaguguacag

SEQ ID NO: 10066 - RNA, 19 nt, Artificial Sequence
  source: /note="Description of Artificial Sequence: Synthetic oligonucleotide"
cuguacacugucuccggaa

SEQ ID NO: 10067 - RNA, 19 nt, Artificial Sequence
  source: /note="Description of Artificial Sequence: Synthetic oligonucleotide"
ggagacaguguacagaguc

SEQ ID NO: 10068 - RNA, 19 nt, Artificial Sequence
  source: /note="Description of Artificial Sequence: Synthetic oligonucleotide"
gacucuguacacugucucc

SEQ ID NO: 10069 - RNA, 19 nt, Artificial Sequence
  source: /note="Description of Artificial Sequence: Synthetic oligonucleotide"
agacaguguacagagucgc

SEQ ID NO: 10070 - RNA, 19 nt, Artificial Sequence
  source: /note="Description of Artificial Sequence: Synthetic oligonucleotide"
gcgacucuguacacugucu

SEQ ID NO: 10071 - RNA, 19 nt, Artificial Sequence
  source: /note="Description of Artificial Sequence: Synthetic oligonucleotide"
uguacagagucgccagaca

SEQ ID NO: 10072 - RNA, 19 nt, Artificial Sequence
  source: /note="Description of Artificial Sequence: Synthetic oligonucleotide"
ugucuggcgacucuguaca

SEQ ID NO: 10073 - RNA, 19 nt, Artificial Sequence
  source: /note="Description of Artificial Sequence: Synthetic oligonucleotide"
acagagucgccagacacua

SEQ ID NO: 10074 - RNA, 19 nt, Artificial Sequence
  source: /note="Description of Artificial Sequence: Synthetic oligonucleotide"
uagugucuggcgacucugu

SEQ ID NO: 10075 - RNA, 19 nt, Artificial Sequence
  source: /note="Description of Artificial Sequence: Synthetic oligonucleotide"
cagagucgccagacacuau

SEQ ID NO: 10076 - RNA, 19 nt, Artificial Sequence
  source: /note="Description of Artificial Sequence: Synthetic oligonucleotide"
auagugucuggcgacucug

SEQ ID NO: 10077 - RNA, 19 nt, Artificial Sequence
  source: /note="Description of Artificial Sequence: Synthetic oligonucleotide"
gucgagccaagcagacacu

SEQ ID NO: 10078 - RNA, 19 nt, Artificial Sequence
  source: /note="Description of Artificial Sequence: Synthetic oligonucleotide"
agugucugcuuggcucgac

SEQ ID NO: 10079 - RNA, 19 nt, Artificial Sequence
  source: /note="Description of Artificial Sequence: Synthetic oligonucleotide"
ucgagccaagcagacacuc

SEQ ID NO: 10080 - RNA, 19 nt, Artificial Sequence
  source: /note="Description of Artificial Sequence: Synthetic oligonucleotide"
gagugucugcuuggcucga

SEQ ID NO: 10081 - RNA, 19 nt, Artificial Sequence
  source: /note="Description of Artificial Sequence: Synthetic oligonucleotide"
cgagccaagcagacacucc

SEQ ID NO: 10082 - RNA, 19 nt, Artificial Sequence
  source: /note="Description of Artificial Sequence: Synthetic oligonucleotide"
ggagugucugcuuggcucg

SEQ ID NO: 10083 - RNA, 19 nt, Artificial Sequence
  source: /note="Description of Artificial Sequence: Synthetic oligonucleotide"
gccaagcagacacucccug

SEQ ID NO: 10084 - RNA, 19 nt, Artificial Sequence
  source: /note="Description of Artificial Sequence: Synthetic oligonucleotide"
cagggagugucugcuuggc

SEQ ID NO: 10085 - RNA, 19 nt, Artificial Sequence
  source: /note="Description of Artificial Sequence: Synthetic oligonucleotide"
ccaagcagacacucccugu

SEQ ID NO: 10086 - RNA, 19 nt, Artificial Sequence
  source: /note="Description of Artificial Sequence: Synthetic oligonucleotide"
acagggagugucugcuugg

SEQ ID NO: 10087 - RNA, 19 nt, Artificial Sequence
  source: /note="Description of Artificial Sequence: Synthetic oligonucleotide"
agcagacacucccugugau

SEQ ID NO: 10088 - RNA, 19 nt, Artificial Sequence
  source: /note="Description of Artificial Sequence: Synthetic oligonucleotide"
aucacagggagugucugcu

SEQ ID NO: 10089 - RNA, 19 nt, Artificial Sequence
  source: /note="Description of Artificial Sequence: Synthetic oligonucleotide"
gcagacacucccugugauc

SEQ ID NO: 10090 - RNA, 19 nt, Artificial Sequence
  source: /note="Description of Artificial Sequence: Synthetic oligonucleotide"
gaucacagggagugucugc

SEQ ID NO: 10091 - RNA, 19 nt, Artificial Sequence
  source: /note="Description of Artificial Sequence: Synthetic oligonucleotide"
cugugaucuaugucaaguu

SEQ ID NO: 10092 - RNA, 19 nt, Artificial Sequence
  source: /note="Description of Artificial Sequence: Synthetic oligonucleotide"
aacuugacauagaucacag

SEQ ID NO: 10093 - RNA, 19 nt, Artificial Sequence
  source: /note="Description of Artificial Sequence: Synthetic oligonucleotide"
cuaugucaaguuguauaug

SEQ ID NO: 10094 - RNA, 19 nt, Artificial Sequence
  source: /note="Description of Artificial Sequence: Synthetic oligonucleotide"
cauauacaacuugacauag

SEQ ID NO: 10095 - RNA, 19 nt, Artificial Sequence
  source: /note="Description of Artificial Sequence: Synthetic oligonucleotide"
augucaaguuguauaugua

SEQ ID NO: 10096 - RNA, 19 nt, Artificial Sequence
  source: /note="Description of Artificial Sequence: Synthetic oligonucleotide"
uacauauacaacuugacau

SEQ ID NO: 10097 - RNA, 19 nt, Artificial Sequence
  source: /note="Description of Artificial Sequence: Synthetic oligonucleotide"
ugucaaguuguauauguau

SEQ ID NO: 10098 - RNA, 19 nt, Artificial Sequence
  source: /note="Description of Artificial Sequence: Synthetic oligonucleotide"
auacauauacaacuugaca

SEQ ID NO: 10099 - RNA, 19 nt, Artificial Sequence
  source: /note="Description of Artificial Sequence: Synthetic oligonucleotide"
caaguuguauauguaucag

SEQ ID NO: 10100 - RNA, 19 nt, Artificial Sequence
  source: /note="Description of Artificial Sequence: Synthetic oligonucleotide"
cugauacauauacaacuug

SEQ ID NO: 10101 - RNA, 19 nt, Artificial Sequence
  source: /note="Description of Artificial Sequence: Synthetic oligonucleotide"
auguaucagcuguucagaa

SEQ ID NO: 10102 - RNA, 19 nt, Artificial Sequence
  source: /note="Description of Artificial Sequence: Synthetic oligonucleotide"
uucugaacagcugauacau

SEQ ID NO: 10103 - RNA, 19 nt, Artificial Sequence
  source: /note="Description of Artificial Sequence: Synthetic oligonucleotide"
uguaucagcuguucagaag

SEQ ID NO: 10104 - RNA, 19 nt, Artificial Sequence
  source: /note="Description of Artificial Sequence: Synthetic oligonucleotide"
cuucugaacagcugauaca

SEQ ID NO: 10105 - RNA, 19 nt, Artificial Sequence
  source: /note="Description of Artificial Sequence: Synthetic oligonucleotide"
agcuguucagaagucuagc

SEQ ID NO: 10106 - RNA, 19 nt, Artificial Sequence
  source: /note="Description of Artificial Sequence: Synthetic oligonucleotide"
gcuagacuucugaacagcu

SEQ ID NO: 10107 - RNA, 19 nt, Artificial Sequence
  source: /note="Description of Artificial Sequence: Synthetic oligonucleotide"
cuauauccauuccuuugga

SEQ ID NO: 10108 - RNA, 19 nt, Artificial Sequence
  source: /note="Description of Artificial Sequence: Synthetic oligonucleotide"
uccaaaggaauggauauag

SEQ ID NO: 10109 - RNA, 19 nt, Artificial Sequence
  source: /note="Description of Artificial Sequence: Synthetic oligonucleotide"
uauauccauuccuuuggaa

SEQ ID NO: 10110 - RNA, 19 nt, Artificial Sequence
  source: /note="Description of Artificial Sequence: Synthetic oligonucleotide"
uuccaaaggaauggauaua

SEQ ID NO: 10111 - RNA, 19 nt, Artificial Sequence
  source: /note="Description of Artificial Sequence: Synthetic oligonucleotide"
ccuuuggaaucugccaucg

SEQ ID NO: 10112 - RNA, 19 nt, Artificial Sequence
  source: /note="Description of Artificial Sequence: Synthetic oligonucleotide"
cgauggcagauuccaaagg

SEQ ID NO: 10113 - RNA, 19 nt, Artificial Sequence
  source: /note="Description of Artificial Sequence: Synthetic oligonucleotide"
uuggaaucugccaucgaga

SEQ ID NO: 10114 - RNA, 19 nt, Artificial Sequence
  source: /note="Description of Artificial Sequence: Synthetic oligonucleotide"
ucucgauggcagauuccaa

SEQ ID NO: 10115 - RNA, 19 nt, Artificial Sequence
  source: /note="Description of Artificial Sequence: Synthetic oligonucleotide"
ggaaucugccaucgagaca

SEQ ID NO: 10116 - RNA, 19 nt, Artificial Sequence
  source: /note="Description of Artificial Sequence: Synthetic oligonucleotide"
ugucucgauggcagauucc

SEQ ID NO: 10117 - RNA, 19 nt, Artificial Sequence
  source: /note="Description of Artificial Sequence: Synthetic oligonucleotide"
cauuaaaccacagaaccuc

SEQ ID NO: 10118 - RNA, 19 nt, Artificial Sequence
  source: /note="Description of Artificial Sequence: Synthetic oligonucleotide"
gagguucugugguuuaaug

SEQ ID NO: 10119 - RNA, 19 nt, Artificial Sequence
  source: /note="Description of Artificial Sequence: Synthetic oligonucleotide"
uuaaaccacagaaccucuu

SEQ ID NO: 10120 - RNA, 19 nt, Artificial Sequence
  source: /note="Description of Artificial Sequence: Synthetic oligonucleotide"
aagagguucugugguuuaa

SEQ ID NO: 10121 - RNA, 19 nt, Artificial Sequence
  source: /note="Description of Artificial Sequence: Synthetic oligonucleotide"
uaaaccacagaaccucuug

SEQ ID NO: 10122 - RNA, 19 nt, Artificial Sequence
  source: /note="Description of Artificial Sequence: Synthetic oligonucleotide"
caagagguucugugguuua

SEQ ID NO: 10123 - RNA, 19 nt, Artificial Sequence
  source: /note="Description of Artificial Sequence: Synthetic oligonucleotide"
aaccacagaaccucuuguu

SEQ ID NO: 10124 - RNA, 19 nt, Artificial Sequence
  source: /note="Description of Artificial Sequence: Synthetic oligonucleotide"
aacaagagguucugugguu

SEQ ID NO: 10125 - RNA, 19 nt, Artificial Sequence
  source: /note="Description of Artificial Sequence: Synthetic oligonucleotide"
ccacagaaccucuuguugg

SEQ ID NO: 10126 - RNA, 19 nt, Artificial Sequence
  source: /note="Description of Artificial Sequence: Synthetic oligonucleotide"
ccaacaagagguucugugg

SEQ ID NO: 10127 - RNA, 19 nt, Artificial Sequence
  source: /note="Description of Artificial Sequence: Synthetic oligonucleotide"
cacagaaccucuuguugga

SEQ ID NO: 10128 - RNA, 19 nt, Artificial Sequence
  source: /note="Description of Artificial Sequence: Synthetic oligonucleotide"
uccaacaagagguucugug

SEQ ID NO: 10129 - RNA, 19 nt, Artificial Sequence
  source: /note="Description of Artificial Sequence: Synthetic oligonucleotide"
cagaaccucuuguuggauc

SEQ ID NO: 10130 - RNA, 19 nt, Artificial Sequence
  source: /note="Description of Artificial Sequence: Synthetic oligonucleotide"
gauccaacaagagguucug

SEQ ID NO: 10131 - RNA, 19 nt, Artificial Sequence
  source: /note="Description of Artificial Sequence: Synthetic oligonucleotide"
cucuuguuggauccugaua

SEQ ID NO: 10132 - RNA, 19 nt, Artificial Sequence
  source: /note="Description of Artificial Sequence: Synthetic oligonucleotide"
uaucaggauccaacaagag

SEQ ID NO: 10133 - RNA, 19 nt, Artificial Sequence
  source: /note="Description of Artificial Sequence: Synthetic oligonucleotide"
cuuguuggauccugauaca

SEQ ID NO: 10134 - RNA, 19 nt, Artificial Sequence
  source: /note="Description of Artificial Sequence: Synthetic oligonucleotide"
uguaucaggauccaacaag

SEQ ID NO: 10135 - RNA, 19 nt, Artificial Sequence
  source: /note="Description of Artificial Sequence: Synthetic oligonucleotide"
uccugauacagcuguauua

SEQ ID NO: 10136 - RNA, 19 nt, Artificial Sequence
  source: /note="Description of Artificial Sequence: Synthetic oligonucleotide"
uaauacagcuguaucagga

SEQ ID NO: 10137 - RNA, 19 nt, Artificial Sequence
  source: /note="Description of Artificial Sequence: Synthetic oligonucleotide"
acagcuguauuaaaacucu

SEQ ID NO: 10138 - RNA, 19 nt, Artificial Sequence
  source: /note="Description of Artificial Sequence: Synthetic oligonucleotide"
agaguuuuaauacagcugu

SEQ ID NO: 10139 - RNA, 19 nt, Artificial Sequence
  source: /note="Description of Artificial Sequence: Synthetic oligonucleotide"
cagcuguauuaaaacucug

SEQ ID NO: 10140 - RNA, 19 nt, Artificial Sequence
  source: /note="Description of Artificial Sequence: Synthetic oligonucleotide"
cagaguuuuaauacagcug

SEQ ID NO: 10141 - RNA, 19 nt, Artificial Sequence
  source: /note="Description of Artificial Sequence: Synthetic oligonucleotide"
gcuguauuaaaacucugug

SEQ ID NO: 10142 - RNA, 19 nt, Artificial Sequence
  source: /note="Description of Artificial Sequence: Synthetic oligonucleotide"
cacagaguuuuaauacagc

SEQ ID NO: 10143 - RNA, 19 nt, Artificial Sequence
  source: /note="Description of Artificial Sequence: Synthetic oligonucleotide"
cuguauuaaaacucuguga

SEQ ID NO: 10144 - RNA, 19 nt, Artificial Sequence
  source: /note="Description of Artificial Sequence: Synthetic oligonucleotide"
ucacagaguuuuaauacag

SEQ ID NO: 10145 - RNA, 19 nt, Artificial Sequence
  source: /note="Description of Artificial Sequence: Synthetic oligonucleotide"
guauuaaaacucugugacu

SEQ ID NO: 10146 - RNA, 19 nt, Artificial Sequence
  source: /note="Description of Artificial Sequence: Synthetic oligonucleotide"
agucacagaguuuuaauac

SEQ ID NO: 10147 - RNA, 19 nt, Artificial Sequence
  source: /note="Description of Artificial Sequence: Synthetic oligonucleotide"
aacucugugacuuuggaag

SEQ ID NO: 10148 - RNA, 19 nt, Artificial Sequence
  source: /note="Description of Artificial Sequence: Synthetic oligonucleotide"
cuuccaaagucacagaguu

SEQ ID NO: 10149 - RNA, 19 nt, Artificial Sequence
  source: /note="Description of Artificial Sequence: Synthetic oligonucleotide"
ugugacuuuggaagugcaa

SEQ ID NO: 10150 - RNA, 19 nt, Artificial Sequence
  source: /note="Description of Artificial Sequence: Synthetic oligonucleotide"
uugcacuuccaaagucaca

SEQ ID NO: 10151 - RNA, 19 nt, Artificial Sequence
  source: /note="Description of Artificial Sequence: Synthetic oligonucleotide"
acuuuggaagugcaaagca

SEQ ID NO: 10152 - RNA, 19 nt, Artificial Sequence
  source: /note="Description of Artificial Sequence: Synthetic oligonucleotide"
ugcuuugcacuuccaaagu

SEQ ID NO: 10153 - RNA, 19 nt, Artificial Sequence
  source: /note="Description of Artificial Sequence: Synthetic oligonucleotide"
agugcaaagcagcuggucc

SEQ ID NO: 10154 - RNA, 19 nt, Artificial Sequence
  source: /note="Description of Artificial Sequence: Synthetic oligonucleotide"
ggaccagcugcuuugcacu

SEQ ID NO: 10155 - RNA, 19 nt, Artificial Sequence
  source: /note="Description of Artificial Sequence: Synthetic oligonucleotide"
ugcaaagcagcugguccga

SEQ ID NO: 10156 - RNA, 19 nt, Artificial Sequence
  source: /note="Description of Artificial Sequence: Synthetic oligonucleotide"
ucggaccagcugcuuugca

SEQ ID NO: 10157 - RNA, 19 nt, Artificial Sequence
  source: /note="Description of Artificial Sequence: Synthetic oligonucleotide"
caaagcagcugguccgagg

SEQ ID NO: 10158 - RNA, 19 nt, Artificial Sequence
  source: /note="Description of Artificial Sequence: Synthetic oligonucleotide"
ccucggaccagcugcuuug

SEQ ID NO: 10159 - RNA, 19 nt, Artificial Sequence
  source: /note="Description of Artificial Sequence: Synthetic oligonucleotide"
agcagcugguccgaggaga

SEQ ID NO: 10160 - RNA, 19 nt, Artificial Sequence
  source: /note="Description of Artificial Sequence: Synthetic oligonucleotide"
ucuccucggaccagcugcu

SEQ ID NO: 10161 - RNA, 19 nt, Artificial Sequence
  source: /note="Description of Artificial Sequence: Synthetic oligonucleotide"
gcagcugguccgaggagag

SEQ ID NO: 10162 - RNA, 19 nt, Artificial Sequence
  source: /note="Description of Artificial Sequence: Synthetic oligonucleotide"
cucuccucggaccagcugc

SEQ ID NO: 10163 - RNA, 19 nt, Artificial Sequence
  source: /note="Description of Artificial Sequence: Synthetic oligonucleotide"
cagcugguccgaggagagc

SEQ ID NO: 10164 - RNA, 19 nt, Artificial Sequence
  source: /note="Description of Artificial Sequence: Synthetic oligonucleotide"
gcucuccucggaccagcug

SEQ ID NO: 10165 - RNA, 19 nt, Artificial Sequence
  source: /note="Description of Artificial Sequence: Synthetic oligonucleotide"
agcugguccgaggagagcc

SEQ ID NO: 10166 - RNA, 19 nt, Artificial Sequence
  source: /note="Description of Artificial Sequence: Synthetic oligonucleotide"
ggcucuccucggaccagcu

SEQ ID NO: 10167 - RNA, 19 nt, Artificial Sequence
  source: /note="Description of Artificial Sequence: Synthetic oligonucleotide"
gguccgaggagagcccaau

SEQ ID NO: 10168 - RNA, 19 nt, Artificial Sequence
  source: /note="Description of Artificial Sequence: Synthetic oligonucleotide"
auugggcucuccucggacc

SEQ ID NO: 10169 - RNA, 19 nt, Artificial Sequence
  source: /note="Description of Artificial Sequence: Synthetic oligonucleotide"
guccgaggagagcccaaug

SEQ ID NO: 10170 - RNA, 19 nt, Artificial Sequence
  source: /note="Description of Artificial Sequence: Synthetic oligonucleotide"
cauugggcucuccucggac

SEQ ID NO: 10171 - RNA, 19 nt, Artificial Sequence
  source: /note="Description of Artificial Sequence: Synthetic oligonucleotide"
ccaauguuucauauaucug

SEQ ID NO: 10172 - RNA, 19 nt, Artificial Sequence
  source: /note="Description of Artificial Sequence: Synthetic oligonucleotide"
cagauauaugaaacauugg

SEQ ID NO: 10173 - RNA, 19 nt, Artificial Sequence
  source: /note="Description of Artificial Sequence: Synthetic oligonucleotide"
uacagggcaccagaguuga

SEQ ID NO: 10174 - RNA, 19 nt, Artificial Sequence
  source: /note="Description of Artificial Sequence: Synthetic oligonucleotide"
ucaacucuggugcccugua

SEQ ID NO: 10175 - RNA, 19 nt, Artificial Sequence
  source: /note="Description of Artificial Sequence: Synthetic oligonucleotide"
cagggcaccagaguugauc

SEQ ID NO: 10176 - RNA, 19 nt, Artificial Sequence
  source: /note="Description of Artificial Sequence: Synthetic oligonucleotide"
gaucaacucuggugcccug

SEQ ID NO: 10177 - RNA, 19 nt, Artificial Sequence
  source: /note="Description of Artificial Sequence: Synthetic oligonucleotide"
ggcaccagaguugaucuuu

SEQ ID NO: 10178 - RNA, 19 nt, Artificial Sequence
  source: /note="Description of Artificial Sequence: Synthetic oligonucleotide"
aaagaucaacucuggugcc

SEQ ID NO: 10179 - RNA, 19 nt, Artificial Sequence
  source: /note="Description of Artificial Sequence: Synthetic oligonucleotide"
gcaccagaguugaucuuug

SEQ ID NO: 10180 - RNA, 19 nt, Artificial Sequence
  source: /note="Description of Artificial Sequence: Synthetic oligonucleotide"
caaagaucaacucuggugc

SEQ ID NO: 10181 - RNA, 19 nt, Artificial Sequence
  source: /note="Description of Artificial Sequence: Synthetic oligonucleotide"
caccagaguugaucuuugg

SEQ ID NO: 10182 - RNA, 19 nt, Artificial Sequence
  source: /note="Description of Artificial Sequence: Synthetic oligonucleotide"
ccaaagaucaacucuggug

SEQ ID NO: 10183 - RNA, 19 nt, Artificial Sequence
  source: /note="Description of Artificial Sequence: Synthetic oligonucleotide"
gaguugaucuuuggagcca

SEQ ID NO: 10184 - RNA, 19 nt, Artificial Sequence
  source: /note="Description of Artificial Sequence: Synthetic oligonucleotide"
uggcuccaaagaucaacuc

SEQ ID NO: 10185 - RNA, 19 nt, Artificial Sequence
  source: /note="Description of Artificial Sequence: Synthetic oligonucleotide"
uuggagccacugauuacac

SEQ ID NO: 10186 - RNA, 19 nt, Artificial Sequence
  source: /note="Description of Artificial Sequence: Synthetic oligonucleotide"
guguaaucaguggcuccaa

SEQ ID NO: 10187 - RNA, 19 nt, Artificial Sequence
  source: /note="Description of Artificial Sequence: Synthetic oligonucleotide"
aguauagauguauggucug

SEQ ID NO: 10188 - RNA, 19 nt, Artificial Sequence
  source: /note="Description of Artificial Sequence: Synthetic oligonucleotide"
cagaccauacaucuauacu

SEQ ID NO: 10189 - RNA, 19 nt, Artificial Sequence
  source: /note="Description of Artificial Sequence: Synthetic oligonucleotide"
uagauguauggucugcagg

SEQ ID NO: 10190 - RNA, 19 nt, Artificial Sequence
  source: /note="Description of Artificial Sequence: Synthetic oligonucleotide"
ccugcagaccauacaucua

SEQ ID NO: 10191 - RNA, 19 nt, Artificial Sequence
  source: /note="Description of Artificial Sequence: Synthetic oligonucleotide"
gauguauggucugcaggcu

SEQ ID NO: 10192 - RNA, 19 nt, Artificial Sequence
  source: /note="Description of Artificial Sequence: Synthetic oligonucleotide"
agccugcagaccauacauc

SEQ ID NO: 10193 - RNA, 19 nt, Artificial Sequence
  source: /note="Description of Artificial Sequence: Synthetic oligonucleotide"
auguauggucugcaggcug

SEQ ID NO: 10194 - RNA, 19 nt, Artificial Sequence
  source: /note="Description of Artificial Sequence: Synthetic oligonucleotide"
cagccugcagaccauacau

SEQ ID NO: 10195 - RNA, 19 nt, Artificial Sequence
  source: /note="Description of Artificial Sequence: Synthetic oligonucleotide"
uguauggucugcaggcugu

SEQ ID NO: 10196 - RNA, 19 nt, Artificial Sequence
  source: /note="Description of Artificial Sequence: Synthetic oligonucleotide"
acagccugcagaccauaca

SEQ ID NO: 10197 - RNA, 19 nt, Artificial Sequence
  source: /note="Description of Artificial Sequence: Synthetic oligonucleotide"
ucugcaggcuguguguugg

SEQ ID NO: 10198 - RNA, 19 nt, Artificial Sequence
  source: /note="Description of Artificial Sequence: Synthetic oligonucleotide"
ccaacacacagccugcaga

SEQ ID NO: 10199 - RNA, 19 nt, Artificial Sequence
  source: /note="Description of Artificial Sequence: Synthetic oligonucleotide"
ggcuguguguuggcugaau

SEQ ID NO: 10200 - RNA, 19 nt, Artificial Sequence
  source: /note="Description of Artificial Sequence: Synthetic oligonucleotide"
auucagccaacacacagcc

SEQ ID NO: 10201 - RNA, 19 nt, Artificial Sequence
  source: /note="Description of Artificial Sequence: Synthetic oligonucleotide"
gcuguguguuggcugaauu

SEQ ID NO: 10202 - RNA, 19 nt, Artificial Sequence
  source: /note="Description of Artificial Sequence: Synthetic oligonucleotide"
aauucagccaacacacagc

SEQ ID NO: 10203 - RNA, 19 nt, Artificial Sequence
  source: /note="Description of Artificial Sequence: Synthetic oligonucleotide"
cuguguguuggcugaauug

SEQ ID NO: 10204 - RNA, 19 nt, Artificial Sequence
  source: /note="Description of Artificial Sequence: Synthetic oligonucleotide"
caauucagccaacacacag

SEQ ID NO: 10205 - RNA, 19 nt, Artificial Sequence
  source: /note="Description of Artificial Sequence: Synthetic oligonucleotide"
guguguuggcugaauuguu

SEQ ID NO: 10206 - RNA, 19 nt, Artificial Sequence
  source: /note="Description of Artificial Sequence: Synthetic oligonucleotide"
aacaauucagccaacacac

SEQ ID NO: 10207 - RNA, 19 nt, Artificial Sequence
  source: /note="Description of Artificial Sequence: Synthetic oligonucleotide"
uguguuggcugaauuguug

SEQ ID NO: 10208 - RNA, 19 nt, Artificial Sequence
  source: /note="Description of Artificial Sequence: Synthetic oligonucleotide"
caacaauucagccaacaca

SEQ ID NO: 10209 - RNA, 19 nt, Artificial Sequence
  source: /note="Description of Artificial Sequence: Synthetic oligonucleotide"
aauuguugcuaggacaacc

SEQ ID NO: 10210 - RNA, 19 nt, Artificial Sequence
  source: /note="Description of Artificial Sequence: Synthetic oligonucleotide"
gguuguccuagcaacaauu

SEQ ID NO: 10211 - RNA, 19 nt, Artificial Sequence
  source: /note="Description of Artificial Sequence: Synthetic oligonucleotide"
uaggacaaccaauauuucc

SEQ ID NO: 10212 - RNA, 19 nt, Artificial Sequence
  source: /note="Description of Artificial Sequence: Synthetic oligonucleotide"
ggaaauauugguuguccua

SEQ ID NO: 10213 - RNA, 19 nt, Artificial Sequence
  source: /note="Description of Artificial Sequence: Synthetic oligonucleotide"
acaaccaauauuuccuggg

SEQ ID NO: 10214 - RNA, 19 nt, Artificial Sequence
  source: /note="Description of Artificial Sequence: Synthetic oligonucleotide"
cccaggaaauauugguugu

SEQ ID NO: 10215 - RNA, 19 nt, Artificial Sequence
  source: /note="Description of Artificial Sequence: Synthetic oligonucleotide"
accaauauuuccuggggac

SEQ ID NO: 10216 - RNA, 19 nt, Artificial Sequence
  source: /note="Description of Artificial Sequence: Synthetic oligonucleotide"
guccccaggaaauauuggu

SEQ ID NO: 10217 - RNA, 19 nt, Artificial Sequence
  source: /note="Description of Artificial Sequence: Synthetic oligonucleotide"
ccaauauuuccuggggaca

SEQ ID NO: 10218 - RNA, 19 nt, Artificial Sequence
  source: /note="Description of Artificial Sequence: Synthetic oligonucleotide"
uguccccaggaaauauugg

SEQ ID NO: 10219 - RNA, 19 nt, Artificial Sequence
  source: /note="Description of Artificial Sequence: Synthetic oligonucleotide"
caauauuuccuggggacag

SEQ ID NO: 10220 - RNA, 19 nt, Artificial Sequence
  source: /note="Description of Artificial Sequence: Synthetic oligonucleotide"
cuguccccaggaaauauug

SEQ ID NO: 10221 - RNA, 19 nt, Artificial Sequence
  source: /note="Description of Artificial Sequence: Synthetic oligonucleotide"
aauauuuccuggggacagu

SEQ ID NO: 10222 - RNA, 19 nt, Artificial Sequence
  source: /note="Description of Artificial Sequence: Synthetic oligonucleotide"
acuguccccaggaaauauu

SEQ ID NO: 10223 - RNA, 19 nt, Artificial Sequence
  source: /note="Description of Artificial Sequence: Synthetic oligonucleotide"
uauuuccuggggacagugg

SEQ ID NO: 10224 - RNA, 19 nt, Artificial Sequence
  source: /note="Description of Artificial Sequence: Synthetic oligonucleotide"
ccacuguccccaggaaaua

SEQ ID NO: 10225 - RNA, 19 nt, Artificial Sequence
  source: /note="Description of Artificial Sequence: Synthetic oligonucleotide"
uggggacagugguguggau

SEQ ID NO: 10226 - RNA, 19 nt, Artificial Sequence
  source: /note="Description of Artificial Sequence: Synthetic oligonucleotide"
auccacaccacugucccca

SEQ ID NO: 10227 - RNA, 19 nt, Artificial Sequence
  source: /note="Description of Artificial Sequence: Synthetic oligonucleotide"
gacagugguguggaucagu

SEQ ID NO: 10228 - RNA, 19 nt, Artificial Sequence
  source: /note="Description of Artificial Sequence: Synthetic oligonucleotide"
acugauccacaccacuguc

SEQ ID NO: 10229 - RNA, 19 nt, Artificial Sequence
  source: /note="Description of Artificial Sequence: Synthetic oligonucleotide"
guguggaucaguuggugga

SEQ ID NO: 10230 - RNA, 19 nt, Artificial Sequence
  source: /note="Description of Artificial Sequence: Synthetic oligonucleotide"
uccaccaacugauccacac

SEQ ID NO: 10231 - RNA, 19 nt, Artificial Sequence
  source: /note="Description of Artificial Sequence: Synthetic oligonucleotide"
aucaguugguggaaauaau

SEQ ID NO: 10232 - RNA, 19 nt, Artificial Sequence
  source: /note="Description of Artificial Sequence: Synthetic oligonucleotide"
auuauuuccaccaacugau

SEQ ID NO: 10233 - RNA, 19 nt, Artificial Sequence
  source: /note="Description of Artificial Sequence: Synthetic oligonucleotide"
guggaaauaauaaaggucc

SEQ ID NO: 10234 - RNA, 19 nt, Artificial Sequence
  source: /note="Description of Artificial Sequence: Synthetic oligonucleotide"
ggaccuuuauuauuuccac

SEQ ID NO: 10235 - RNA, 19 nt, Artificial Sequence
  source: /note="Description of Artificial Sequence: Synthetic oligonucleotide"
gaaauaauaaagguccuag

SEQ ID NO: 10236 - RNA, 19 nt, Artificial Sequence
  source: /note="Description of Artificial Sequence: Synthetic oligonucleotide"
cuaggaccuuuauuauuuc

SEQ ID NO: 10237 - RNA, 19 nt, Artificial Sequence
  source: /note="Description of Artificial Sequence: Synthetic oligonucleotide"
auaaagguccuaggaacac

SEQ ID NO: 10238 - RNA, 19 nt, Artificial Sequence
  source: /note="Description of Artificial Sequence: Synthetic oligonucleotide"
guguuccuaggaccuuuau

SEQ ID NO: 10239 - RNA, 19 nt, Artificial Sequence
  source: /note="Description of Artificial Sequence: Synthetic oligonucleotide"
aaagguccuaggaacacca

SEQ ID NO: 10240 - RNA, 19 nt, Artificial Sequence
  source: /note="Description of Artificial Sequence: Synthetic oligonucleotide"
ugguguuccuaggaccuuu

SEQ ID NO: 10241 - RNA, 19 nt, Artificial Sequence
  source: /note="Description of Artificial Sequence: Synthetic oligonucleotide"
ccuaggaacaccaacaagg

SEQ ID NO: 10242 - RNA, 19 nt, Artificial Sequence
  source: /note="Description of Artificial Sequence: Synthetic oligonucleotide"
ccuuguugguguuccuagg

SEQ ID NO: 10243 - RNA, 19 nt, Artificial Sequence
  source: /note="Description of Artificial Sequence: Synthetic oligonucleotide"
ggaacaccaacaagggagc

SEQ ID NO: 10244 - RNA, 19 nt, Artificial Sequence
  source: /note="Description of Artificial Sequence: Synthetic oligonucleotide"
gcucccuuguugguguucc

SEQ ID NO: 10245 - RNA, 19 nt, Artificial Sequence
  source: /note="Description of Artificial Sequence: Synthetic oligonucleotide"
aagggagcaaauuagagaa

SEQ ID NO: 10246 - RNA, 19 nt, Artificial Sequence
  source: /note="Description of Artificial Sequence: Synthetic oligonucleotide"
uucucuaauuugcucccuu

SEQ ID NO: 10247 - RNA, 19 nt, Artificial Sequence
  source: /note="Description of Artificial Sequence: Synthetic oligonucleotide"
gggagcaaauuagagaaau

SEQ ID NO: 10248 - RNA, 19 nt, Artificial Sequence
  source: /note="Description of Artificial Sequence: Synthetic oligonucleotide"
auuucucuaauuugcuccc

SEQ ID NO: 10249 - RNA, 19 nt, Artificial Sequence
  source: /note="Description of Artificial Sequence: Synthetic oligonucleotide"
aaauuagagaaaugaaccc

SEQ ID NO: 10250 - RNA, 19 nt, Artificial Sequence
  source: /note="Description of Artificial Sequence: Synthetic oligonucleotide"
ggguucauuucucuaauuu

SEQ ID NO: 10251 - RNA, 19 nt, Artificial Sequence
  source: /note="Description of Artificial Sequence: Synthetic oligonucleotide"
aauuagagaaaugaaccca

SEQ ID NO: 10252 - RNA, 19 nt, Artificial Sequence
  source: /note="Description of Artificial Sequence: Synthetic oligonucleotide"
uggguucauuucucuaauu

SEQ ID NO: 10253 - RNA, 19 nt, Artificial Sequence
  source: /note="Description of Artificial Sequence: Synthetic oligonucleotide"
uagagaaaugaacccaaau

SEQ ID NO: 10254 - RNA, 19 nt, Artificial Sequence
  source: /note="Description of Artificial Sequence: Synthetic oligonucleotide"
auuuggguucauuucucua

SEQ ID NO: 10255 - RNA, 19 nt, Artificial Sequence
  source: /note="Description of Artificial Sequence: Synthetic oligonucleotide"
agagaaaugaacccaaauu

SEQ ID NO: 10256 - RNA, 19 nt, Artificial Sequence
  source: /note="Description of Artificial Sequence: Synthetic oligonucleotide"
aauuuggguucauuucucu

SEQ ID NO: 10257 - RNA, 19 nt, Artificial Sequence
  source: /note="Description of Artificial Sequence: Synthetic oligonucleotide"
agaaaugaacccaaauuau

SEQ ID NO: 10258 - RNA, 19 nt, Artificial Sequence
  source: /note="Description of Artificial Sequence: Synthetic oligonucleotide"
auaauuuggguucauuucu

SEQ ID NO: 10259 - RNA, 19 nt, Artificial Sequence
  source: /note="Description of Artificial Sequence: Synthetic oligonucleotide"
gaaaugaacccaaauuaua

SEQ ID NO: 10260 - RNA, 19 nt, Artificial Sequence
  source: /note="Description of Artificial Sequence: Synthetic oligonucleotide"
uauaauuuggguucauuuc

SEQ ID NO: 10261 - RNA, 19 nt, Artificial Sequence
  source: /note="Description of Artificial Sequence: Synthetic oligonucleotide"
aaugaacccaaauuauaca

SEQ ID NO: 10262 - RNA, 19 nt, Artificial Sequence
  source: /note="Description of Artificial Sequence: Synthetic oligonucleotide"
uguauaauuuggguucauu

SEQ ID NO: 10263 - RNA, 19 nt, Artificial Sequence
  source: /note="Description of Artificial Sequence: Synthetic oligonucleotide"
augaacccaaauuauacag

SEQ ID NO: 10264 - RNA, 19 nt, Artificial Sequence
  source: /note="Description of Artificial Sequence: Synthetic oligonucleotide"
cuguauaauuuggguucau

SEQ ID NO: 10265 - RNA, 19 nt, Artificial Sequence
  source: /note="Description of Artificial Sequence: Synthetic oligonucleotide"
ccaaauuauacagaauuca

SEQ ID NO: 10266 - RNA, 19 nt, Artificial Sequence
  source: /note="Description of Artificial Sequence: Synthetic oligonucleotide"
ugaauucuguauaauuugg

SEQ ID NO: 10267 - RNA, 19 nt, Artificial Sequence
  source: /note="Description of Artificial Sequence: Synthetic oligonucleotide"
uuauacagaauucaaauuc

SEQ ID NO: 10268 - RNA, 19 nt, Artificial Sequence
  source: /note="Description of Artificial Sequence: Synthetic oligonucleotide"
gaauuugaauucuguauaa

SEQ ID NO: 10269 - RNA, 19 nt, Artificial Sequence
  source: /note="Description of Artificial Sequence: Synthetic oligonucleotide"
uauacagaauucaaauucc

SEQ ID NO: 10270 - RNA, 19 nt, Artificial Sequence
  source: /note="Description of Artificial Sequence: Synthetic oligonucleotide"
ggaauuugaauucuguaua

SEQ ID NO: 10271 - RNA, 19 nt, Artificial Sequence
  source: /note="Description of Artificial Sequence: Synthetic oligonucleotide"
auacagaauucaaauuccc

SEQ ID NO: 10272 - RNA, 19 nt, Artificial Sequence
  source: /note="Description of Artificial Sequence: Synthetic oligonucleotide"
gggaauuugaauucuguau

SEQ ID NO: 10273 - RNA, 19 nt, Artificial Sequence
  source: /note="Description of Artificial Sequence: Synthetic oligonucleotide"
uucaaauucccucaaauca

SEQ ID NO: 10274 - RNA, 19 nt, Artificial Sequence
  source: /note="Description of Artificial Sequence: Synthetic oligonucleotide"
ugauuugagggaauuugaa

SEQ ID NO: 10275 - RNA, 19 nt, Artificial Sequence
  source: /note="Description of Artificial Sequence: Synthetic oligonucleotide"
caaauucccucaaaucaag

SEQ ID NO: 10276 - RNA, 19 nt, Artificial Sequence
  source: /note="Description of Artificial Sequence: Synthetic oligonucleotide"
cuugauuugagggaauuug

SEQ ID NO: 10277 - RNA, 19 nt, Artificial Sequence
  source: /note="Description of Artificial Sequence: Synthetic oligonucleotide"
aaauucccucaaaucaagg

SEQ ID NO: 10278 - RNA, 19 nt, Artificial Sequence
  source: /note="Description of Artificial Sequence: Synthetic oligonucleotide"
ccuugauuugagggaauuu

SEQ ID NO: 10279 - RNA, 19 nt, Artificial Sequence
  source: /note="Description of Artificial Sequence: Synthetic oligonucleotide"
cucaaaucaaggcacaucc

SEQ ID NO: 10280 - RNA, 19 nt, Artificial Sequence
  source: /note="Description of Artificial Sequence: Synthetic oligonucleotide"
ggaugugccuugauuugag

SEQ ID NO: 10281 - RNA, 19 nt, Artificial Sequence
  source: /note="Description of Artificial Sequence: Synthetic oligonucleotide"
ucaaaucaaggcacauccu

SEQ ID NO: 10282 - RNA, 19 nt, Artificial Sequence
  source: /note="Description of Artificial Sequence: Synthetic oligonucleotide"
aggaugugccuugauuuga

SEQ ID NO: 10283 - RNA, 19 nt, Artificial Sequence
  source: /note="Description of Artificial Sequence: Synthetic oligonucleotide"
aaucaaggcacauccuugg

SEQ ID NO: 10284 - RNA, 19 nt, Artificial Sequence
  source: /note="Description of Artificial Sequence: Synthetic oligonucleotide"
ccaaggaugugccuugauu

SEQ ID NO: 10285 - RNA, 19 nt, Artificial Sequence
  source: /note="Description of Artificial Sequence: Synthetic oligonucleotide"
aucaaggcacauccuugga

SEQ ID NO: 10286 - RNA, 19 nt, Artificial Sequence
  source: /note="Description of Artificial Sequence: Synthetic oligonucleotide"
uccaaggaugugccuugau

SEQ ID NO: 10287 - RNA, 19 nt, Artificial Sequence
  source: /note="Description of Artificial Sequence: Synthetic oligonucleotide"
caaggcacauccuuggaca

SEQ ID NO: 10288 - RNA, 19 nt, Artificial Sequence
  source: /note="Description of Artificial Sequence: Synthetic oligonucleotide"
uguccaaggaugugccuug

SEQ ID NO: 10289 - RNA, 19 nt, Artificial Sequence
  source: /note="Description of Artificial Sequence: Synthetic oligonucleotide"
aggcacauccuuggacaaa

SEQ ID NO: 10290 - RNA, 19 nt, Artificial Sequence
  source: /note="Description of Artificial Sequence: Synthetic oligonucleotide"
uuuguccaaggaugugccu

SEQ ID NO: 10291 - RNA, 19 nt, Artificial Sequence
  source: /note="Description of Artificial Sequence: Synthetic oligonucleotide"
ggcacauccuuggacaaag

SEQ ID NO: 10292 - RNA, 19 nt, Artificial Sequence
  source: /note="Description of Artificial Sequence: Synthetic oligonucleotide"
cuuuguccaaggaugugcc

SEQ ID NO: 10293 - RNA, 19 nt, Artificial Sequence
  source: /note="Description of Artificial Sequence: Synthetic oligonucleotide"
gcacauccuuggacaaagg

SEQ ID NO: 10294 - RNA, 19 nt, Artificial Sequence
  source: /note="Description of Artificial Sequence: Synthetic oligonucleotide"
ccuuuguccaaggaugugc

SEQ ID NO: 10295 - RNA, 19 nt, Artificial Sequence
  source: /note="Description of Artificial Sequence: Synthetic oligonucleotide"
cacauccuuggacaaaggu

SEQ ID NO: 10296 - RNA, 19 nt, Artificial Sequence
  source: /note="Description of Artificial Sequence: Synthetic oligonucleotide"
accuuuguccaaggaugug

SEQ ID NO: 10297 - RNA, 19 nt, Artificial Sequence
  source: /note="Description of Artificial Sequence: Synthetic oligonucleotide"
cauccuuggacaaaggucu

SEQ ID NO: 10298 - RNA, 19 nt, Artificial Sequence
  source: /note="Description of Artificial Sequence: Synthetic oligonucleotide"
agaccuuuguccaaggaug

SEQ ID NO: 10299 - RNA, 19 nt, Artificial Sequence
  source: /note="Description of Artificial Sequence: Synthetic oligonucleotide"
uccuuggacaaaggucuuc

SEQ ID NO: 10300 - RNA, 19 nt, Artificial Sequence
  source: /note="Description of Artificial Sequence: Synthetic oligonucleotide"
gaagaccuuuguccaagga

SEQ ID NO: 10301 - RNA, 19 nt, Artificial Sequence
  source: /note="Description of Artificial Sequence: Synthetic oligonucleotide"
uggacaaaggucuuccggc

SEQ ID NO: 10302 - RNA, 19 nt, Artificial Sequence
  source: /note="Description of Artificial Sequence: Synthetic oligonucleotide"
gccggaagaccuuugucca

SEQ ID NO: 10303 - RNA, 19 nt, Artificial Sequence
  source: /note="Description of Artificial Sequence: Synthetic oligonucleotide"
caaaggucuuccggccccg

SEQ ID NO: 10304 - RNA, 19 nt, Artificial Sequence
  source: /note="Description of Artificial Sequence: Synthetic oligonucleotide"
cggggccggaagaccuuug

SEQ ID NO: 10305 - RNA, 19 nt, Artificial Sequence
  source: /note="Description of Artificial Sequence: Synthetic oligonucleotide"
uccggccccgaacuccacc

SEQ ID NO: 10306 - RNA, 19 nt, Artificial Sequence
  source: /note="Description of Artificial Sequence: Synthetic oligonucleotide"
gguggaguucggggccgga

SEQ ID NO: 10307 - RNA, 19 nt, Artificial Sequence
  source: /note="Description of Artificial Sequence: Synthetic oligonucleotide"
gccccgaacuccaccagag

SEQ ID NO: 10308 - RNA, 19 nt, Artificial Sequence
  source: /note="Description of Artificial Sequence: Synthetic oligonucleotide"
cucugguggaguucggggc

SEQ ID NO: 10309 - RNA, 19 nt, Artificial Sequence
  source: /note="Description of Artificial Sequence: Synthetic oligonucleotide"
ccccgaacuccaccagagg

SEQ ID NO: 10310 - RNA, 19 nt, Artificial Sequence
  source: /note="Description of Artificial Sequence: Synthetic oligonucleotide"
ccucugguggaguucgggg

SEQ ID NO: 10311 - RNA, 19 nt, Artificial Sequence
  source: /note="Description of Artificial Sequence: Synthetic oligonucleotide"
ccgaacuccaccagaggca

SEQ ID NO: 10312 - RNA, 19 nt, Artificial Sequence
  source: /note="Description of Artificial Sequence: Synthetic oligonucleotide"
ugccucugguggaguucgg

SEQ ID NO: 10313 - RNA, 19 nt, Artificial Sequence
  source: /note="Description of Artificial Sequence: Synthetic oligonucleotide"
cgaacuccaccagaggcaa

SEQ ID NO: 10314 - RNA, 19 nt, Artificial Sequence
  source: /note="Description of Artificial Sequence: Synthetic oligonucleotide"
uugccucugguggaguucg

SEQ ID NO: 10315 - RNA, 19 nt, Artificial Sequence
  source: /note="Description of Artificial Sequence: Synthetic oligonucleotide"
gaacuccaccagaggcaau

SEQ ID NO: 10316 - RNA, 19 nt, Artificial Sequence
  source: /note="Description of Artificial Sequence: Synthetic oligonucleotide"
auugccucugguggaguuc

SEQ ID NO: 10317 - RNA, 19 nt, Artificial Sequence
  source: /note="Description of Artificial Sequence: Synthetic oligonucleotide"
agaggcaauugcacugugc

SEQ ID NO: 10318 - RNA, 19 nt, Artificial Sequence
  source: /note="Description of Artificial Sequence: Synthetic oligonucleotide"
gcacagugcaauugccucu

SEQ ID NO: 10319 - RNA, 19 nt, Artificial Sequence
  source: /note="Description of Artificial Sequence: Synthetic oligonucleotide"
gaggcaauugcacugugca

SEQ ID NO: 10320 - RNA, 19 nt, Artificial Sequence
  source: /note="Description of Artificial Sequence: Synthetic oligonucleotide"
ugcacagugcaauugccuc

SEQ ID NO: 10321 - RNA, 19 nt, Artificial Sequence
  source: /note="Description of Artificial Sequence: Synthetic oligonucleotide"
ggcaauugcacugugcagc

SEQ ID NO: 10322 - RNA, 19 nt, Artificial Sequence
  source: /note="Description of Artificial Sequence: Synthetic oligonucleotide"
gcugcacagugcaauugcc

SEQ ID NO: 10323 - RNA, 19 nt, Artificial Sequence
  source: /note="Description of Artificial Sequence: Synthetic oligonucleotide"
gcaauugcacugugcagcc

SEQ ID NO: 10324 - RNA, 19 nt, Artificial Sequence
  source: /note="Description of Artificial Sequence: Synthetic oligonucleotide"
ggcugcacagugcaauugc

SEQ ID NO: 10325 - RNA, 19 nt, Artificial Sequence
  source: /note="Description of Artificial Sequence: Synthetic oligonucleotide"
aauugcacugugcagccgu

SEQ ID NO: 10326 - RNA, 19 nt, Artificial Sequence
  source: /note="Description of Artificial Sequence: Synthetic oligonucleotide"
acggcugcacagugcaauu

SEQ ID NO: 10327 - RNA, 19 nt, Artificial Sequence
  source: /note="Description of Artificial Sequence: Synthetic oligonucleotide"
auugcacugugcagccguc

SEQ ID NO: 10328 - RNA, 19 nt, Artificial Sequence
  source: /note="Description of Artificial Sequence: Synthetic oligonucleotide"
gacggcugcacagugcaau

SEQ ID NO: 10329 - RNA, 19 nt, Artificial Sequence
  source: /note="Description of Artificial Sequence: Synthetic oligonucleotide"
cugugcagccgucugcugg

SEQ ID NO: 10330 - RNA, 19 nt, Artificial Sequence
  source: /note="Description of Artificial Sequence: Synthetic oligonucleotide"
ccagcagacggcugcacag

SEQ ID NO: 10331 - RNA, 19 nt, Artificial Sequence
  source: /note="Description of Artificial Sequence: Synthetic oligonucleotide"
gcuggaguacacaccuacc

SEQ ID NO: 10332 - RNA, 19 nt, Artificial Sequence
  source: /note="Description of Artificial Sequence: Synthetic oligonucleotide"
gguagguguguacuccagc

SEQ ID NO: 10333 - RNA, 19 nt, Artificial Sequence
  source: /note="Description of Artificial Sequence: Synthetic oligonucleotide"
cggcuaacaccacuggaag

SEQ ID NO: 10334 - RNA, 19 nt, Artificial Sequence
  source: /note="Description of Artificial Sequence: Synthetic oligonucleotide"
cuuccagugguguuagccg

SEQ ID NO: 10335 - RNA, 19 nt, Artificial Sequence
  source: /note="Description of Artificial Sequence: Synthetic oligonucleotide"
gcuaacaccacuggaagcu

SEQ ID NO: 10336 - RNA, 19 nt, Artificial Sequence
  source: /note="Description of Artificial Sequence: Synthetic oligonucleotide"
agcuuccagugguguuagc

SEQ ID NO: 10337 - RNA, 19 nt, Artificial Sequence
  source: /note="Description of Artificial Sequence: Synthetic oligonucleotide"
cuaacaccacuggaagcuu

SEQ ID NO: 10338 - RNA, 19 nt, Artificial Sequence
  source: /note="Description of Artificial Sequence: Synthetic oligonucleotide"
aagcuuccagugguguuag

SEQ ID NO: 10339 - RNA, 19 nt, Artificial Sequence
  source: /note="Description of Artificial Sequence: Synthetic oligonucleotide"
aacaccacuggaagcuugu

SEQ ID NO: 10340 - RNA, 19 nt, Artificial Sequence
  source: /note="Description of Artificial Sequence: Synthetic oligonucleotide"
acaagcuuccagugguguu

SEQ ID NO: 10341 - RNA, 19 nt, Artificial Sequence
  source: /note="Description of Artificial Sequence: Synthetic oligonucleotide"
acaccacuggaagcuugug

SEQ ID NO: 10342 - RNA, 19 nt, Artificial Sequence
  source: /note="Description of Artificial Sequence: Synthetic oligonucleotide"
cacaagcuuccaguggugu

SEQ ID NO: 10343 - RNA, 19 nt, Artificial Sequence
  source: /note="Description of Artificial Sequence: Synthetic oligonucleotide"
caccacuggaagcuugugc

SEQ ID NO: 10344 - RNA, 19 nt, Artificial Sequence
  source: /note="Description of Artificial Sequence: Synthetic oligonucleotide"
gcacaagcuuccaguggug

SEQ ID NO: 10345 - RNA, 19 nt, Artificial Sequence
  source: /note="Description of Artificial Sequence: Synthetic oligonucleotide"
accacuggaagcuugugca

SEQ ID NO: 10346 - RNA, 19 nt, Artificial Sequence
  source: /note="Description of Artificial Sequence: Synthetic oligonucleotide"
ugcacaagcuuccaguggu

SEQ ID NO: 10347 - RNA, 19 nt, Artificial Sequence
  source: /note="Description of Artificial Sequence: Synthetic oligonucleotide"
cacuggaagcuugugcaca

SEQ ID NO: 10348 - RNA, 19 nt, Artificial Sequence
  source: /note="Description of Artificial Sequence: Synthetic oligonucleotide"
ugugcacaagcuuccagug

SEQ ID NO: 10349 - RNA, 19 nt, Artificial Sequence
  source: /note="Description of Artificial Sequence: Synthetic oligonucleotide"
cuggaagcuugugcacauu

SEQ ID NO: 10350 - RNA, 19 nt, Artificial Sequence
  source: /note="Description of Artificial Sequence: Synthetic oligonucleotide"
aaugugcacaagcuuccag

SEQ ID NO: 10351 - RNA, 19 nt, Artificial Sequence
  source: /note="Description of Artificial Sequence: Synthetic oligonucleotide"
uggaagcuugugcacauuc

SEQ ID NO: 10352 - RNA, 19 nt, Artificial Sequence
  source: /note="Description of Artificial Sequence: Synthetic oligonucleotide"
gaaugugcacaagcuucca

SEQ ID NO: 10353 - RNA, 19 nt, Artificial Sequence
  source: /note="Description of Artificial Sequence: Synthetic oligonucleotide"
ggaagcuugugcacauuca

SEQ ID NO: 10354 - RNA, 19 nt, Artificial Sequence
  source: /note="Description of Artificial Sequence: Synthetic oligonucleotide"
ugaaugugcacaagcuucc

SEQ ID NO: 10355 - RNA, 19 nt, Artificial Sequence
  source: /note="Description of Artificial Sequence: Synthetic oligonucleotide"
gaagcuugugcacauucau

SEQ ID NO: 10356 - RNA, 19 nt, Artificial Sequence
  source: /note="Description of Artificial Sequence: Synthetic oligonucleotide"
augaaugugcacaagcuuc

SEQ ID NO: 10357 - RNA, 19 nt, Artificial Sequence
  source: /note="Description of Artificial Sequence: Synthetic oligonucleotide"
agcuugugcacauucauuu

SEQ ID NO: 10358 - RNA, 19 nt, Artificial Sequence
  source: /note="Description of Artificial Sequence: Synthetic oligonucleotide"
aaaugaaugugcacaagcu

SEQ ID NO: 10359 - RNA, 19 nt, Artificial Sequence
  source: /note="Description of Artificial Sequence: Synthetic oligonucleotide"
agagcugcaagccagugca

SEQ ID NO: 10360 - RNA, 19 nt, Artificial Sequence
  source: /note="Description of Artificial Sequence: Synthetic oligonucleotide"
ugcacuggcuugcagcucu

SEQ ID NO: 10361 - RNA, 19 nt, Artificial Sequence
  source: /note="Description of Artificial Sequence: Synthetic oligonucleotide"
gagcugcaagccagugcag

SEQ ID NO: 10362 - RNA, 19 nt, Artificial Sequence
  source: /note="Description of Artificial Sequence: Synthetic oligonucleotide"
cugcacuggcuugcagcuc

SEQ ID NO: 10363 - RNA, 19 nt, Artificial Sequence
  source: /note="Description of Artificial Sequence: Synthetic oligonucleotide"
ugcagcagccuucagcuuu

SEQ ID NO: 10364 - RNA, 19 nt, Artificial Sequence
  source: /note="Description of Artificial Sequence: Synthetic oligonucleotide"
aaagcugaaggcugcugca

SEQ ID NO: 10365 - RNA, 19 nt, Artificial Sequence
  source: /note="Description of Artificial Sequence: Synthetic oligonucleotide"
gcagagauaaagauggcag

SEQ ID NO: 10366 - RNA, 19 nt, Artificial Sequence
  source: /note="Description of Artificial Sequence: Synthetic oligonucleotide"
cugccaucuuuaucucugc

SEQ ID NO: 10367 - RNA, 19 nt, Artificial Sequence
  source: /note="Description of Artificial Sequence: Synthetic oligonucleotide"
caggguccugacaggccac

SEQ ID NO: 10368 - RNA, 19 nt, Artificial Sequence
  source: /note="Description of Artificial Sequence: Synthetic oligonucleotide"
guggccugucaggacccug

SEQ ID NO: 10369 - RNA, 19 nt, Artificial Sequence
  source: /note="Description of Artificial Sequence: Synthetic oligonucleotide"
agaaaguucuacaggacaa

SEQ ID NO: 10370 - RNA, 19 nt, Artificial Sequence
  source: /note="Description of Artificial Sequence: Synthetic oligonucleotide"
uuguccuguagaacuuucu

SEQ ID NO: 10371 - RNA, 19 nt, Artificial Sequence
  source: /note="Description of Artificial Sequence: Synthetic oligonucleotide"
ugcuggacuauguuccgga

SEQ ID NO: 10372 - RNA, 19 nt, Artificial Sequence
  source: /note="Description of Artificial Sequence: Synthetic oligonucleotide"
uccggaacauaguccagca

SEQ ID NO: 10373 - RNA, 19 nt, Artificial Sequence
  source: /note="Description of Artificial Sequence: Synthetic oligonucleotide"
uaucagcuguucagaaguc

SEQ ID NO: 10374 - RNA, 19 nt, Artificial Sequence
  source: /note="Description of Artificial Sequence: Synthetic oligonucleotide"
gacuucugaacagcugaua

SEQ ID NO: 10375 - RNA, 19 nt, Artificial Sequence
  source: /note="Description of Artificial Sequence: Synthetic oligonucleotide"
cauuccuuuggaaucugcc

SEQ ID NO: 10376 - RNA, 19 nt, Artificial Sequence
  source: /note="Description of Artificial Sequence: Synthetic oligonucleotide"
ggcagauuccaaaggaaug

SEQ ID NO: 10377 - RNA, 19 nt, Artificial Sequence
  source: /note="Description of Artificial Sequence: Synthetic oligonucleotide"
aaucugccaucgagacauu

SEQ ID NO: 10378 - RNA, 19 nt, Artificial Sequence
  source: /note="Description of Artificial Sequence: Synthetic oligonucleotide"
aaugucucgauggcagauu

SEQ ID NO: 10379 - RNA, 19 nt, Artificial Sequence
  source: /note="Description of Artificial Sequence: Synthetic oligonucleotide"
gacauuaaaccacagaacc

SEQ ID NO: 10380 - RNA, 19 nt, Artificial Sequence
  source: /note="Description of Artificial Sequence: Synthetic oligonucleotide"
gguucugugguuuaauguc

SEQ ID NO: 10381 - RNA, 19 nt, Artificial Sequence
  source: /note="Description of Artificial Sequence: Synthetic oligonucleotide"
ccgaggagagcccaauguu

SEQ ID NO: 10382 - RNA, 19 nt, Artificial Sequence
  source: /note="Description of Artificial Sequence: Synthetic oligonucleotide"
aacauugggcucuccucgg

SEQ ID NO: 10383 - RNA, 19 nt, Artificial Sequence
  source: /note="Description of Artificial Sequence: Synthetic oligonucleotide"
gucugcaggcuguguguug

SEQ ID NO: 10384 - RNA, 19 nt, Artificial Sequence
  source: /note="Description of Artificial Sequence: Synthetic oligonucleotide"
caacacacagccugcagac

SEQ ID NO: 10385 - RNA, 19 nt, Artificial Sequence
  source: /note="Description of Artificial Sequence: Synthetic oligonucleotide"
ggacagugguguggaucag

SEQ ID NO: 10386 - RNA, 19 nt, Artificial Sequence
  source: /note="Description of Artificial Sequence: Synthetic oligonucleotide"
cugauccacaccacugucc

SEQ ID NO: 10387 - RNA, 19 nt, Artificial Sequence
  source: /note="Description of Artificial Sequence: Synthetic oligonucleotide"
auaauaaagguccuaggaa

SEQ ID NO: 10388 - RNA, 19 nt, Artificial Sequence
  source: /note="Description of Artificial Sequence: Synthetic oligonucleotide"
uuccuaggaccuuuauuau

SEQ ID NO: 10389 - RNA, 19 nt, Artificial Sequence
  source: /note="Description of Artificial Sequence: Synthetic oligonucleotide"
gcaaauuagagaaaugaac

SEQ ID NO: 10390 - RNA, 19 nt, Artificial Sequence
  source: /note="Description of Artificial Sequence: Synthetic oligonucleotide"
guucauuucucuaauuugc

SEQ ID NO: 10391 - RNA, 19 nt, Artificial Sequence
  source: /note="Description of Artificial Sequence: Synthetic oligonucleotide"
auuagagaaaugaacccaa

SEQ ID NO: 10392 - RNA, 19 nt, Artificial Sequence
  source: /note="Description of Artificial Sequence: Synthetic oligonucleotide"
uuggguucauuucucuaau

SEQ ID NO: 10393 - RNA, 19 nt, Artificial Sequence
  source: /note="Description of Artificial Sequence: Synthetic oligonucleotide"
aacccaaauuauacagaau

SEQ ID NO: 10394 - RNA, 19 nt, Artificial Sequence
  source: /note="Description of Artificial Sequence: Synthetic oligonucleotide"
auucuguauaauuuggguu

SEQ ID NO: 10395 - RNA, 19 nt, Artificial Sequence
  source: /note="Description of Artificial Sequence: Synthetic oligonucleotide"
aaggucuuccggccccgaa

SEQ ID NO: 10396 - RNA, 19 nt, Artificial Sequence
  source: /note="Description of Artificial Sequence: Synthetic oligonucleotide"
uucggggccggaagaccuu

SEQ ID NO: 10397 - RNA, 19 nt, Artificial Sequence
  source: /note="Description of Artificial Sequence: Synthetic oligonucleotide"
cggccccgaacuccaccag

SEQ ID NO: 10398 - RNA, 19 nt, Artificial Sequence
  source: /note="Description of Artificial Sequence: Synthetic oligonucleotide"
cugguggaguucggggccg

SEQ ID NO: 10399 - RNA, 19 nt, Artificial Sequence
  source: /note="Description of Artificial Sequence: Synthetic oligonucleotide"
ccagaggcaauugcacugu

SEQ ID NO: 10400 - RNA, 19 nt, Artificial Sequence
  source: /note="Description of Artificial Sequence: Synthetic oligonucleotide"
acagugcaauugccucugg

SEQ ID NO: 10401 - RNA, 19 nt, Artificial Sequence
  source: /note="Description of Artificial Sequence: Synthetic oligonucleotide"
ugugcagccgucugcugga

SEQ ID NO: 10402 - RNA, 19 nt, Artificial Sequence
  source: /note="Description of Artificial Sequence: Synthetic oligonucleotide"
uccagcagacggcugcaca

SEQ ID NO: 10403 - RNA, 19 nt, Artificial Sequence
  source: /note="Description of Artificial Sequence: Synthetic oligonucleotide"
ccgagaaccaccuccuuug

SEQ ID NO: 10404 - RNA, 19 nt, Artificial Sequence
  source: /note="Description of Artificial Sequence: Synthetic oligonucleotide"
caaaggaggugguucucgg

SEQ ID NO: 10405 - RNA, 19 nt, Artificial Sequence
  source: /note="Description of Artificial Sequence: Synthetic oligonucleotide"
cgagaaccaccuccuuugc

SEQ ID NO: 10406 - RNA, 19 nt, Artificial Sequence
  source: /note="Description of Artificial Sequence: Synthetic oligonucleotide"
gcaaaggaggugguucucg

SEQ ID NO: 10407 - RNA, 19 nt, Artificial Sequence
  source: /note="Description of Artificial Sequence: Synthetic oligonucleotide"
accuccuuugcggagagcu

SEQ ID NO: 10408 - RNA, 19 nt, Artificial Sequence
  source: /note="Description of Artificial Sequence: Synthetic oligonucleotide"
agcucuccgcaaaggaggu

SEQ ID NO: 10409 - RNA, 19 nt, Artificial Sequence
  source: /note="Description of Artificial Sequence: Synthetic oligonucleotide"
ccuuugcggagagcugcaa

SEQ ID NO: 10410 - RNA, 19 nt, Artificial Sequence
  source: /note="Description of Artificial Sequence: Synthetic oligonucleotide"
uugcagcucuccgcaaagg

SEQ ID NO: 10411 - RNA, 19 nt, Artificial Sequence
  source: /note="Description of Artificial Sequence: Synthetic oligonucleotide"
ggagagcugcaagccagug

SEQ ID NO: 10412 - RNA, 19 nt, Artificial Sequence
  source: /note="Description of Artificial Sequence: Synthetic oligonucleotide"
cacuggcuugcagcucucc

SEQ ID NO: 10413 - RNA, 19 nt, Artificial Sequence
  source: /note="Description of Artificial Sequence: Synthetic oligonucleotide"
agugcagcagccuucagcu

SEQ ID NO: 10414 - RNA, 19 nt, Artificial Sequence
  source: /note="Description of Artificial Sequence: Synthetic oligonucleotide"
agcugaaggcugcugcacu

SEQ ID NO: 10415 - RNA, 19 nt, Artificial Sequence
  source: /note="Description of Artificial Sequence: Synthetic oligonucleotide"
gugcagcagccuucagcuu

SEQ ID NO: 10416 - RNA, 19 nt, Artificial Sequence
  source: /note="Description of Artificial Sequence: Synthetic oligonucleotide"
aagcugaaggcugcugcac

SEQ ID NO: 10417 - RNA, 19 nt, Artificial Sequence
  source: /note="Description of Artificial Sequence: Synthetic oligonucleotide"
cuucagcuuuugguagcau

SEQ ID NO: 10418 - RNA, 19 nt, Artificial Sequence
  source: /note="Description of Artificial Sequence: Synthetic oligonucleotide"
augcuaccaaaagcugaag

SEQ ID NO: 10419 - RNA, 19 nt, Artificial Sequence
  source: /note="Description of Artificial Sequence: Synthetic oligonucleotide"
ugguagcaugaaaguuagc

SEQ ID NO: 10420 - RNA, 19 nt, Artificial Sequence
  source: /note="Description of Artificial Sequence: Synthetic oligonucleotide"
gcuaacuuucaugcuacca

SEQ ID NO: 10421 - RNA, 19 nt, Artificial Sequence
  source: /note="Description of Artificial Sequence: Synthetic oligonucleotide"
gcaugaaaguuagcagaga

SEQ ID NO: 10422 - RNA, 19 nt, Artificial Sequence
  source: /note="Description of Artificial Sequence: Synthetic oligonucleotide"
ucucugcuaacuuucaugc

SEQ ID NO: 10423 - RNA, 19 nt, Artificial Sequence
  source: /note="Description of Artificial Sequence: Synthetic oligonucleotide"
caugaaaguuagcagagau

SEQ ID NO: 10424 - RNA, 19 nt, Artificial Sequence
  source: /note="Description of Artificial Sequence: Synthetic oligonucleotide"
aucucugcuaacuuucaug

SEQ ID NO: 10425 - RNA, 19 nt, Artificial Sequence
  source: /note="Description of Artificial Sequence: Synthetic oligonucleotide"
agagauaaagauggcagca

SEQ ID NO: 10426 - RNA, 19 nt, Artificial Sequence
  source: /note="Description of Artificial Sequence: Synthetic oligonucleotide"
ugcugccaucuuuaucucu

SEQ ID NO: 10427 - RNA, 19 nt, Artificial Sequence
  source: /note="Description of Artificial Sequence: Synthetic oligonucleotide"
gagauaaagauggcagcaa

SEQ ID NO: 10428 - RNA, 19 nt, Artificial Sequence
  source: /note="Description of Artificial Sequence: Synthetic oligonucleotide"
uugcugccaucuuuaucuc

SEQ ID NO: 10429 - RNA, 19 nt, Artificial Sequence
  source: /note="Description of Artificial Sequence: Synthetic oligonucleotide"
caagguaaccacaguagug

SEQ ID NO: 10430 - RNA, 19 nt, Artificial Sequence
  source: /note="Description of Artificial Sequence: Synthetic oligonucleotide"
cacuacugugguuaccuug

SEQ ID NO: 10431 - RNA, 19 nt, Artificial Sequence
  source: /note="Description of Artificial Sequence: Synthetic oligonucleotide"
caacuccuggccagggucc

SEQ ID NO: 10432 - RNA, 19 nt, Artificial Sequence
  source: /note="Description of Artificial Sequence: Synthetic oligonucleotide"
ggacccuggccaggaguug

SEQ ID NO: 10433 - RNA, 19 nt, Artificial Sequence
  source: /note="Description of Artificial Sequence: Synthetic oligonucleotide"
acuccuggccaggguccug

SEQ ID NO: 10434 - RNA, 19 nt, Artificial Sequence
  source: /note="Description of Artificial Sequence: Synthetic oligonucleotide"
caggacccuggccaggagu

SEQ ID NO: 10435 - RNA, 19 nt, Artificial Sequence
  source: /note="Description of Artificial Sequence: Synthetic oligonucleotide"
cuccuggccaggguccuga

SEQ ID NO: 10436 - RNA, 19 nt, Artificial Sequence
  source: /note="Description of Artificial Sequence: Synthetic oligonucleotide"
ucaggacccuggccaggag

SEQ ID NO: 10437 - RNA, 19 nt, Artificial Sequence
  source: /note="Description of Artificial Sequence: Synthetic oligonucleotide"
uccuggccaggguccugac

SEQ ID NO: 10438 - RNA, 19 nt, Artificial Sequence
  source: /note="Description of Artificial Sequence: Synthetic oligonucleotide"
gucaggacccuggccagga

SEQ ID NO: 10439 - RNA, 19 nt, Artificial Sequence
  source: /note="Description of Artificial Sequence: Synthetic oligonucleotide"
guccugacaggccacagga

SEQ ID NO: 10440 - RNA, 19 nt, Artificial Sequence
  source: /note="Description of Artificial Sequence: Synthetic oligonucleotide"
uccuguggccugucaggac

SEQ ID NO: 10441 - RNA, 19 nt, Artificial Sequence
  source: /note="Description of Artificial Sequence: Synthetic oligonucleotide"
aggccacaggaagucaguu

SEQ ID NO: 10442 - RNA, 19 nt, Artificial Sequence
  source: /note="Description of Artificial Sequence: Synthetic oligonucleotide"
aacugacuuccuguggccu

SEQ ID NO: 10443 - RNA, 19 nt, Artificial Sequence
  source: /note="Description of Artificial Sequence: Synthetic oligonucleotide"
aguuauacagacacgaaag

SEQ ID NO: 10444 - RNA, 19 nt, Artificial Sequence
  source: /note="Description of Artificial Sequence: Synthetic oligonucleotide"
cuuucgugucuguauaacu

SEQ ID NO: 10445 - RNA, 19 nt, Artificial Sequence
  source: /note="Description of Artificial Sequence: Synthetic oligonucleotide"
ccaaacuuugugauucugg

SEQ ID NO: 10446 - RNA, 19 nt, Artificial Sequence
  source: /note="Description of Artificial Sequence: Synthetic oligonucleotide"
ccagaaucacaaaguuugg

SEQ ID NO: 10447 - RNA, 19 nt, Artificial Sequence
  source: /note="Description of Artificial Sequence: Synthetic oligonucleotide"
caaacuuugugauucugga

SEQ ID NO: 10448 - RNA, 19 nt, Artificial Sequence
  source: /note="Description of Artificial Sequence: Synthetic oligonucleotide"
uccagaaucacaaaguuug

SEQ ID NO: 10449 - RNA, 19 nt, Artificial Sequence
  source: /note="Description of Artificial Sequence: Synthetic oligonucleotide"
aaacuuugugauucuggag

SEQ ID NO: 10450 - RNA, 19 nt, Artificial Sequence
  source: /note="Description of Artificial Sequence: Synthetic oligonucleotide"
cuccagaaucacaaaguuu

SEQ ID NO: 10451 - RNA, 19 nt, Artificial Sequence
  source: /note="Description of Artificial Sequence: Synthetic oligonucleotide"
aacuuugugauucuggaga

SEQ ID NO: 10452 - RNA, 19 nt, Artificial Sequence
  source: /note="Description of Artificial Sequence: Synthetic oligonucleotide"
ucuccagaaucacaaaguu

SEQ ID NO: 10453 - RNA, 19 nt, Artificial Sequence
  source: /note="Description of Artificial Sequence: Synthetic oligonucleotide"
gaaaguucuacaggacaag

SEQ ID NO: 10454 - RNA, 19 nt, Artificial Sequence
  source: /note="Description of Artificial Sequence: Synthetic oligonucleotide"
cuuguccuguagaacuuuc

SEQ ID NO: 10455 - RNA, 19 nt, Artificial Sequence
  source: /note="Description of Artificial Sequence: Synthetic oligonucleotide"
aaaguucuacaggacaagc

SEQ ID NO: 10456 - RNA, 19 nt, Artificial Sequence
  source: /note="Description of Artificial Sequence: Synthetic oligonucleotide"
gcuuguccuguagaacuuu

SEQ ID NO: 10457 - RNA, 19 nt, Artificial Sequence
  source: /note="Description of Artificial Sequence: Synthetic oligonucleotide"
aaguucuacaggacaagcg

SEQ ID NO: 10458 - RNA, 19 nt, Artificial Sequence
  source: /note="Description of Artificial Sequence: Synthetic oligonucleotide"
cgcuuguccuguagaacuu

SEQ ID NO: 10459 - RNA, 19 nt, Artificial Sequence
  source: /note="Description of Artificial Sequence: Synthetic oligonucleotide"
accgagagcuccagaucau

SEQ ID NO: 10460 - RNA, 19 nt, Artificial Sequence
  source: /note="Description of Artificial Sequence: Synthetic oligonucleotide"
augaucuggagcucucggu

SEQ ID NO: 10461 - RNA, 19 nt, Artificial Sequence
  source: /note="Description of Artificial Sequence: Synthetic oligonucleotide"
aguggugagaagaaagaug

SEQ ID NO: 10462 - RNA, 19 nt, Artificial Sequence
  source: /note="Description of Artificial Sequence: Synthetic oligonucleotide"
caucuuucuucucaccacu

SEQ ID NO: 10463 - RNA, 19 nt, Artificial Sequence
  source: /note="Description of Artificial Sequence: Synthetic oligonucleotide"
ugagaagaaagaugagguc

SEQ ID NO: 10464 - RNA, 19 nt, Artificial Sequence
  source: /note="Description of Artificial Sequence: Synthetic oligonucleotide"
gaccucaucuuucuucuca

SEQ ID NO: 10465 - RNA, 19 nt, Artificial Sequence
  source: /note="Description of Artificial Sequence: Synthetic oligonucleotide"
aagaaagaugaggucuacc

SEQ ID NO: 10466 - RNA, 19 nt, Artificial Sequence
  source: /note="Description of Artificial Sequence: Synthetic oligonucleotide"
gguagaccucaucuuucuu

SEQ ID NO: 10467 - RNA, 19 nt, Artificial Sequence
  source: /note="Description of Artificial Sequence: Synthetic oligonucleotide"
auuccuuuggaaucugcca

SEQ ID NO: 10468 - RNA, 19 nt, Artificial Sequence
  source: /note="Description of Artificial Sequence: Synthetic oligonucleotide"
uggcagauuccaaaggaau

SEQ ID NO: 10469 - RNA, 19 nt, Artificial Sequence
  source: /note="Description of Artificial Sequence: Synthetic oligonucleotide"
uggaaucugccaucgagac

SEQ ID NO: 10470 - RNA, 19 nt, Artificial Sequence
  source: /note="Description of Artificial Sequence: Synthetic oligonucleotide"
gucucgauggcagauucca

SEQ ID NO: 10471 - RNA, 19 nt, Artificial Sequence
  source: /note="Description of Artificial Sequence: Synthetic oligonucleotide"
ggauccugauacagcugua

SEQ ID NO: 10472 - RNA, 19 nt, Artificial Sequence
  source: /note="Description of Artificial Sequence: Synthetic oligonucleotide"
uacagcuguaucaggaucc

SEQ ID NO: 10473 - RNA, 19 nt, Artificial Sequence
  source: /note="Description of Artificial Sequence: Synthetic oligonucleotide"
acucugugacuuuggaagu

SEQ ID NO: 10474 - RNA, 19 nt, Artificial Sequence
  source: /note="Description of Artificial Sequence: Synthetic oligonucleotide"
acuuccaaagucacagagu

SEQ ID NO: 10475 - RNA, 19 nt, Artificial Sequence
  source: /note="Description of Artificial Sequence: Synthetic oligonucleotide"
gcugguccgaggagagccc

SEQ ID NO: 10476 - RNA, 19 nt, Artificial Sequence
  source: /note="Description of Artificial Sequence: Synthetic oligonucleotide"
gggcucuccucggaccagc

SEQ ID NO: 10477 - RNA, 19 nt, Artificial Sequence
  source: /note="Description of Artificial Sequence: Synthetic oligonucleotide"
cccaauguuucauauaucu

SEQ ID NO: 10478 - RNA, 19 nt, Artificial Sequence
  source: /note="Description of Artificial Sequence: Synthetic oligonucleotide"
agauauaugaaacauuggg

SEQ ID NO: 10479 - RNA, 19 nt, Artificial Sequence
  source: /note="Description of Artificial Sequence: Synthetic oligonucleotide"
auguuucauauaucuguuc

SEQ ID NO: 10480 - RNA, 19 nt, Artificial Sequence
  source: /note="Description of Artificial Sequence: Synthetic oligonucleotide"
gaacagauauaugaaacau

SEQ ID NO: 10481 - RNA, 19 nt, Artificial Sequence
  source: /note="Description of Artificial Sequence: Synthetic oligonucleotide"
aucuuuggagccacugauu

SEQ ID NO: 10482 - RNA, 19 nt, Artificial Sequence
  source: /note="Description of Artificial Sequence: Synthetic oligonucleotide"
aaucaguggcuccaaagau

SEQ ID NO: 10483 - RNA, 19 nt, Artificial Sequence
  source: /note="Description of Artificial Sequence: Synthetic oligonucleotide"
ggucugcaggcuguguguu

SEQ ID NO: 10484 - RNA, 19 nt, Artificial Sequence
  source: /note="Description of Artificial Sequence: Synthetic oligonucleotide"
aacacacagccugcagacc

SEQ ID NO: 10485 - RNA, 19 nt, Artificial Sequence
  source: /note="Description of Artificial Sequence: Synthetic oligonucleotide"
ugcaggcuguguguuggcu

SEQ ID NO: 10486 - RNA, 19 nt, Artificial Sequence
  source: /note="Description of Artificial Sequence: Synthetic oligonucleotide"
agccaacacacagccugca

SEQ ID NO: 10487 - RNA, 19 nt, Artificial Sequence
  source: /note="Description of Artificial Sequence: Synthetic oligonucleotide"
guguuggcugaauuguugc

SEQ ID NO: 10488 - RNA, 19 nt, Artificial Sequence
  source: /note="Description of Artificial Sequence: Synthetic oligonucleotide"
gcaacaauucagccaacac

SEQ ID NO: 10489 - RNA, 19 nt, Artificial Sequence
  source: /note="Description of Artificial Sequence: Synthetic oligonucleotide"
cuggggacaguggugugga

SEQ ID NO: 10490 - RNA, 19 nt, Artificial Sequence
  source: /note="Description of Artificial Sequence: Synthetic oligonucleotide"
uccacaccacuguccccag

SEQ ID NO: 10491 - RNA, 19 nt, Artificial Sequence
  source: /note="Description of Artificial Sequence: Synthetic oligonucleotide"
ggggacagugguguggauc

SEQ ID NO: 10492 - RNA, 19 nt, Artificial Sequence
  source: /note="Description of Artificial Sequence: Synthetic oligonucleotide"
gauccacaccacugucccc

SEQ ID NO: 10493 - RNA, 19 nt, Artificial Sequence
  source: /note="Description of Artificial Sequence: Synthetic oligonucleotide"
gggacagugguguggauca

SEQ ID NO: 10494 - RNA, 19 nt, Artificial Sequence
  source: /note="Description of Artificial Sequence: Synthetic oligonucleotide"
ugauccacaccacuguccc

SEQ ID NO: 10495 - RNA, 19 nt, Artificial Sequence
  source: /note="Description of Artificial Sequence: Synthetic oligonucleotide"
aguugguggaaauaauaaa

SEQ ID NO: 10496 - RNA, 19 nt, Artificial Sequence
  source: /note="Description of Artificial Sequence: Synthetic oligonucleotide"
uuuauuauuuccaccaacu

SEQ ID NO: 10497 - RNA, 19 nt, Artificial Sequence
  source: /note="Description of Artificial Sequence: Synthetic oligonucleotide"
gguggaaauaauaaagguc

SEQ ID NO: 10498 - RNA, 19 nt, Artificial Sequence
  source: /note="Description of Artificial Sequence: Synthetic oligonucleotide"
gaccuuuauuauuuccacc

SEQ ID NO: 10499 - RNA, 19 nt, Artificial Sequence
  source: /note="Description of Artificial Sequence: Synthetic oligonucleotide"
uggaaauaauaaagguccu

SEQ ID NO: 10500 - RNA, 19 nt, Artificial Sequence
  source: /note="Description of Artificial Sequence: Synthetic oligonucleotide"
aggaccuuuauuauuucca

SEQ ID NO: 10501 - RNA, 19 nt, Artificial Sequence
  source: /note="Description of Artificial Sequence: Synthetic oligonucleotide"
caaauuagagaaaugaacc

SEQ ID NO: 10502 - RNA, 19 nt, Artificial Sequence
  source: /note="Description of Artificial Sequence: Synthetic oligonucleotide"
gguucauuucucuaauuug

SEQ ID NO: 10503 - RNA, 19 nt, Artificial Sequence
  source: /note="Description of Artificial Sequence: Synthetic oligonucleotide"
ugaacccaaauuauacaga

SEQ ID NO: 10504 - RNA, 19 nt, Artificial Sequence
  source: /note="Description of Artificial Sequence: Synthetic oligonucleotide"
ucuguauaauuuggguuca

SEQ ID NO: 10505 - RNA, 19 nt, Artificial Sequence
  source: /note="Description of Artificial Sequence: Synthetic oligonucleotide"
gaacccaaauuauacagaa

SEQ ID NO: 10506 - RNA, 19 nt, Artificial Sequence
  source: /note="Description of Artificial Sequence: Synthetic oligonucleotide"
uucuguauaauuuggguuc

SEQ ID NO: 10507 - RNA, 19 nt, Artificial Sequence
  source: /note="Description of Artificial Sequence: Synthetic oligonucleotide"
aaauuauacagaauucaaa

SEQ ID NO: 10508 - RNA, 19 nt, Artificial Sequence
  source: /note="Description of Artificial Sequence: Synthetic oligonucleotide"
uuugaauucuguauaauuu

SEQ ID NO: 10509 - RNA, 19 nt, Artificial Sequence
  source: /note="Description of Artificial Sequence: Synthetic oligonucleotide"
cagaauucaaauucccuca

SEQ ID NO: 10510 - RNA, 19 nt, Artificial Sequence
  source: /note="Description of Artificial Sequence: Synthetic oligonucleotide"
ugagggaauuugaauucug

SEQ ID NO: 10511 - RNA, 19 nt, Artificial Sequence
  source: /note="Description of Artificial Sequence: Synthetic oligonucleotide"
aauucaaauucccucaaau

SEQ ID NO: 10512 - RNA, 19 nt, Artificial Sequence
  source: /note="Description of Artificial Sequence: Synthetic oligonucleotide"
auuugagggaauuugaauu

SEQ ID NO: 10513 - RNA, 19 nt, Artificial Sequence
  source: /note="Description of Artificial Sequence: Synthetic oligonucleotide"
ucuuccggccccgaacucc

SEQ ID NO: 10514 - RNA, 19 nt, Artificial Sequence
  source: /note="Description of Artificial Sequence: Synthetic oligonucleotide"
ggaguucggggccggaaga

SEQ ID NO: 10515 - RNA, 19 nt, Artificial Sequence
  source: /note="Description of Artificial Sequence: Synthetic oligonucleotide"
ggccccgaacuccaccaga

SEQ ID NO: 10516 - RNA, 19 nt, Artificial Sequence
  source: /note="Description of Artificial Sequence: Synthetic oligonucleotide"
ucugguggaguucggggcc

SEQ ID NO: 10517 - RNA, 19 nt, Artificial Sequence
  source: /note="Description of Artificial Sequence: Synthetic oligonucleotide"
aacuccaccagaggcaauu

SEQ ID NO: 10518 - RNA, 19 nt, Artificial Sequence
  source: /note="Description of Artificial Sequence: Synthetic oligonucleotide"
aauugccucugguggaguu

SEQ ID NO: 10519 - RNA, 19 nt, Artificial Sequence
  source: /note="Description of Artificial Sequence: Synthetic oligonucleotide"
acuccaccagaggcaauug

SEQ ID NO: 10520 - RNA, 19 nt, Artificial Sequence
  source: /note="Description of Artificial Sequence: Synthetic oligonucleotide"
caauugccucugguggagu

SEQ ID NO: 10521 - RNA, 19 nt, Artificial Sequence
  source: /note="Description of Artificial Sequence: Synthetic oligonucleotide"
cagaggcaauugcacugug

SEQ ID NO: 10522 - RNA, 19 nt, Artificial Sequence
  source: /note="Description of Artificial Sequence: Synthetic oligonucleotide"
cacagugcaauugccucug

SEQ ID NO: 10523 - RNA, 19 nt, Artificial Sequence
  source: /note="Description of Artificial Sequence: Synthetic oligonucleotide"
acugugcagccgucugcug

SEQ ID NO: 10524 - RNA, 19 nt, Artificial Sequence
  source: /note="Description of Artificial Sequence: Synthetic oligonucleotide"
cagcagacggcugcacagu

SEQ ID NO: 10525 - RNA, 19 nt, Artificial Sequence
  source: /note="Description of Artificial Sequence: Synthetic oligonucleotide"
gugcagccgucugcuggag

SEQ ID NO: 10526 - RNA, 19 nt, Artificial Sequence
  source: /note="Description of Artificial Sequence: Synthetic oligonucleotide"
cuccagcagacggcugcac

SEQ ID NO: 10527 - RNA, 19 nt, Artificial Sequence
  source: /note="Description of Artificial Sequence: Synthetic oligonucleotide"
gcagccgucugcuggagua

SEQ ID NO: 10528 - RNA, 19 nt, Artificial Sequence
  source: /note="Description of Artificial Sequence: Synthetic oligonucleotide"
uacuccagcagacggcugc

SEQ ID NO: 10529 - RNA, 19 nt, Artificial Sequence
  source: /note="Description of Artificial Sequence: Synthetic oligonucleotide"
cagagauaaagauggcagc

SEQ ID NO: 10530 - RNA, 19 nt, Artificial Sequence
  source: /note="Description of Artificial Sequence: Synthetic oligonucleotide"
gcugccaucuuuaucucug

SEQ ID NO: 10531 - RNA, 19 nt, Artificial Sequence
  source: /note="Description of Artificial Sequence: Synthetic oligonucleotide"
uaagaaccgagagcuccag

SEQ ID NO: 10532 - RNA, 19 nt, Artificial Sequence
  source: /note="Description of Artificial Sequence: Synthetic oligonucleotide"
cuggagcucucgguucuua

SEQ ID NO: 10533 - RNA, 19 nt, Artificial Sequence
  source: /note="Description of Artificial Sequence: Synthetic oligonucleotide"
aagaaccgagagcuccaga

SEQ ID NO: 10534 - RNA, 19 nt, Artificial Sequence
  source: /note="Description of Artificial Sequence: Synthetic oligonucleotide"
ucuggagcucucgguucuu

SEQ ID NO: 10535 - RNA, 19 nt, Artificial Sequence
  source: /note="Description of Artificial Sequence: Synthetic oligonucleotide"
gaagaaagaugaggucuac

SEQ ID NO: 10536 - RNA, 19 nt, Artificial Sequence
  source: /note="Description of Artificial Sequence: Synthetic oligonucleotide"
guagaccucaucuuucuuc

SEQ ID NO: 10537 - RNA, 19 nt, Artificial Sequence
  source: /note="Description of Artificial Sequence: Synthetic oligonucleotide"
guuucauauaucuguucuc

SEQ ID NO: 10538 - RNA, 19 nt, Artificial Sequence
  source: /note="Description of Artificial Sequence: Synthetic oligonucleotide"
gagaacagauauaugaaac

SEQ ID NO: 10539 - RNA, 19 nt, Artificial Sequence
  source: /note="Description of Artificial Sequence: Synthetic oligonucleotide"
aauaaagguccuaggaaca

SEQ ID NO: 10540 - RNA, 19 nt, Artificial Sequence
  source: /note="Description of Artificial Sequence: Synthetic oligonucleotide"
uguuccuaggaccuuuauu

SEQ ID NO: 10541 - RNA, 19 nt, Artificial Sequence
  source: /note="Description of Artificial Sequence: Synthetic oligonucleotide"
acuggaagcuugugcacau

SEQ ID NO: 10542 - RNA, 19 nt, Artificial Sequence
  source: /note="Description of Artificial Sequence: Synthetic oligonucleotide"
augugcacaagcuuccagu

SEQ ID NO: 10543 - RNA, 19 nt, Artificial Sequence
  source: /note="Description of Artificial Sequence: Synthetic oligonucleotide"
ugcaagccagugcagcagc

SEQ ID NO: 10544 - RNA, 19 nt, Artificial Sequence
  source: /note="Description of Artificial Sequence: Synthetic oligonucleotide"
gcugcugcacuggcuugca

SEQ ID NO: 10545 - RNA, 19 nt, Artificial Sequence
  source: /note="Description of Artificial Sequence: Synthetic oligonucleotide"
agccagugcagcagccuuc

SEQ ID NO: 10546 - RNA, 19 nt, Artificial Sequence
  source: /note="Description of Artificial Sequence: Synthetic oligonucleotide"
gaaggcugcugcacuggcu

SEQ ID NO: 10547 - RNA, 19 nt, Artificial Sequence
  source: /note="Description of Artificial Sequence: Synthetic oligonucleotide"
aagguaaccacaguagugg

SEQ ID NO: 10548 - RNA, 19 nt, Artificial Sequence
  source: /note="Description of Artificial Sequence: Synthetic oligonucleotide"
ccacuacugugguuaccuu

SEQ ID NO: 10549 - RNA, 19 nt, Artificial Sequence
  source: /note="Description of Artificial Sequence: Synthetic oligonucleotide"
gccaggguccugacaggcc

SEQ ID NO: 10550 - RNA, 19 nt, Artificial Sequence
  source: /note="Description of Artificial Sequence: Synthetic oligonucleotide"
ggccugucaggacccuggc

SEQ ID NO: 10551 - RNA, 19 nt, Artificial Sequence
  source: /note="Description of Artificial Sequence: Synthetic oligonucleotide"
uggaaauggaucauuuggu

SEQ ID NO: 10552 - RNA, 19 nt, Artificial Sequence
  source: /note="Description of Artificial Sequence: Synthetic oligonucleotide"
accaaaugauccauuucca

SEQ ID NO: 10553 - RNA, 19 nt, Artificial Sequence
  source: /note="Description of Artificial Sequence: Synthetic oligonucleotide"
uucuggagaacugguugcc

SEQ ID NO: 10554 - RNA, 19 nt, Artificial Sequence
  source: /note="Description of Artificial Sequence: Synthetic oligonucleotide"
ggcaaccaguucuccagaa

SEQ ID NO: 10555 - RNA, 19 nt, Artificial Sequence
  source: /note="Description of Artificial Sequence: Synthetic oligonucleotide"
gagaacugguugccaucaa

SEQ ID NO: 10556 - RNA, 19 nt, Artificial Sequence
  source: /note="Description of Artificial Sequence: Synthetic oligonucleotide"
uugauggcaaccaguucuc

SEQ ID NO: 10557 - RNA, 19 nt, Artificial Sequence
  source: /note="Description of Artificial Sequence: Synthetic oligonucleotide"
agaacugguugccaucaag

SEQ ID NO: 10558 - RNA, 19 nt, Artificial Sequence
  source: /note="Description of Artificial Sequence: Synthetic oligonucleotide"
cuugauggcaaccaguucu

SEQ ID NO: 10559 - RNA, 19 nt, Artificial Sequence
  source: /note="Description of Artificial Sequence: Synthetic oligonucleotide"
gucaaguuguauauguauc

SEQ ID NO: 10560 - RNA, 19 nt, Artificial Sequence
  source: /note="Description of Artificial Sequence: Synthetic oligonucleotide"
gauacauauacaacuugac

SEQ ID NO: 10561 - RNA, 19 nt, Artificial Sequence
  source: /note="Description of Artificial Sequence: Synthetic oligonucleotide"
uccauuccuuuggaaucug

SEQ ID NO: 10562 - RNA, 19 nt, Artificial Sequence
  source: /note="Description of Artificial Sequence: Synthetic oligonucleotide"
cagauuccaaaggaaugga

SEQ ID NO: 10563 - RNA, 19 nt, Artificial Sequence
  source: /note="Description of Artificial Sequence: Synthetic oligonucleotide"
gugcaaagcagcugguccg

SEQ ID NO: 10564 - RNA, 19 nt, Artificial Sequence
  source: /note="Description of Artificial Sequence: Synthetic oligonucleotide"
cggaccagcugcuuugcac

SEQ ID NO: 10565 - RNA, 19 nt, Artificial Sequence
  source: /note="Description of Artificial Sequence: Synthetic oligonucleotide"
uacuacagggcaccagagu

SEQ ID NO: 10566 - RNA, 19 nt, Artificial Sequence
  source: /note="Description of Artificial Sequence: Synthetic oligonucleotide"
acucuggugcccuguagua

SEQ ID NO: 10567 - RNA, 19 nt, Artificial Sequence
  source: /note="Description of Artificial Sequence: Synthetic oligonucleotide"
cugcaggcuguguguuggc

SEQ ID NO: 10568 - RNA, 19 nt, Artificial Sequence
  source: /note="Description of Artificial Sequence: Synthetic oligonucleotide"
gccaacacacagccugcag

SEQ ID NO: 10569 - RNA, 19 nt, Artificial Sequence
  source: /note="Description of Artificial Sequence: Synthetic oligonucleotide"
uugcacugugcagccgucu

SEQ ID NO: 10570 - RNA, 19 nt, Artificial Sequence
  source: /note="Description of Artificial Sequence: Synthetic oligonucleotide"
agacggcugcacagugcaa

SEQ ID NO: 10571 - RNA, 19 nt, Artificial Sequence
  source: /note="Description of Artificial Sequence: Synthetic oligonucleotide"
aagcuugugcacauucauu

SEQ ID NO: 10572 - RNA, 19 nt, Artificial Sequence
  source: /note="Description of Artificial Sequence: Synthetic oligonucleotide"
aaugaaugugcacaagcuu

SEQ ID NO: 10573 - RNA, 19 nt, Artificial Sequence
  source: /note="Description of Artificial Sequence: Synthetic oligonucleotide"
ccuccuuugcggagagcug

SEQ ID NO: 10574 - RNA, 19 nt, Artificial Sequence
  source: /note="Description of Artificial Sequence: Synthetic oligonucleotide"
cagcucuccgcaaaggagg

SEQ ID NO: 10575 - RNA, 19 nt, Artificial Sequence
  source: /note="Description of Artificial Sequence: Synthetic oligonucleotide"
gcaagccagugcagcagcc

SEQ ID NO: 10576 - RNA, 19 nt, Artificial Sequence
  source: /note="Description of Artificial Sequence: Synthetic oligonucleotide"
ggcugcugcacuggcuugc

SEQ ID NO: 10577 - RNA, 19 nt, Artificial Sequence
  source: /note="Description of Artificial Sequence: Synthetic oligonucleotide"
cuggccaggguccugacag

SEQ ID NO: 10578 - RNA, 19 nt, Artificial Sequence
  source: /note="Description of Artificial Sequence: Synthetic oligonucleotide"
cugucaggacccuggccag

SEQ ID NO: 10579 - RNA, 19 nt, Artificial Sequence
  source: /note="Description of Artificial Sequence: Synthetic oligonucleotide"
gaacugguugccaucaaga

SEQ ID NO: 10580 - RNA, 19 nt, Artificial Sequence
  source: /note="Description of Artificial Sequence: Synthetic oligonucleotide"
ucuugauggcaaccaguuc

SEQ ID NO: 10581 - RNA, 19 nt, Artificial Sequence
  source: /note="Description of Artificial Sequence: Synthetic oligonucleotide"
guacuacagggcaccagag

SEQ ID NO: 10582 - RNA, 19 nt, Artificial Sequence
  source: /note="Description of Artificial Sequence: Synthetic oligonucleotide"
cucuggugcccuguaguac

SEQ ID NO: 10583 - RNA, 19 nt, Artificial Sequence
  source: /note="Description of Artificial Sequence: Synthetic oligonucleotide"
uggagccacugauuacacg

SEQ ID NO: 10584 - RNA, 19 nt, Artificial Sequence
  source: /note="Description of Artificial Sequence: Synthetic oligonucleotide"
cguguaaucaguggcucca

SEQ ID NO: 10585 - RNA, 19 nt, Artificial Sequence
  source: /note="Description of Artificial Sequence: Synthetic oligonucleotide"
uggcugaauuguugcuagg

SEQ ID NO: 10586 - RNA, 19 nt, Artificial Sequence
  source: /note="Description of Artificial Sequence: Synthetic oligonucleotide"
ccuagcaacaauucagcca

SEQ ID NO: 10587 - RNA, 19 nt, Artificial Sequence
  source: /note="Description of Artificial Sequence: Synthetic oligonucleotide"
ggaaauaauaaagguccua

SEQ ID NO: 10588 - RNA, 19 nt, Artificial Sequence
  source: /note="Description of Artificial Sequence: Synthetic oligonucleotide"
uaggaccuuuauuauuucc

SEQ ID NO: 10589 - RNA, 19 nt, Artificial Sequence
  source: /note="Description of Artificial Sequence: Synthetic oligonucleotide"
uuggacaaaggucuuccgg

SEQ ID NO: 10590 - RNA, 19 nt, Artificial Sequence
  source: /note="Description of Artificial Sequence: Synthetic oligonucleotide"
ccggaagaccuuuguccaa

SEQ ID NO: 10591 - RNA, 19 nt, Artificial Sequence
  source: /note="Description of Artificial Sequence: Synthetic oligonucleotide"
auagucgagccaagcagac

SEQ ID NO: 10592 - RNA, 19 nt, Artificial Sequence
  source: /note="Description of Artificial Sequence: Synthetic oligonucleotide"
gucugcuuggcucgacuau

SEQ ID NO: 10593 - RNA, 19 nt, Artificial Sequence
  source: /note="Description of Artificial Sequence: Synthetic oligonucleotide"
uuaagaaccgagagcucca

SEQ ID NO: 10594 - RNA, 19 nt, Artificial Sequence
  source: /note="Description of Artificial Sequence: Synthetic oligonucleotide"
uggagcucucgguucuuaa

SEQ ID NO: 10595 - RNA, 19 nt, Artificial Sequence
  source: /note="Description of Artificial Sequence: Synthetic oligonucleotide"
aaccgagagcuccagauca

SEQ ID NO: 10596 - RNA, 19 nt, Artificial Sequence
  source: /note="Description of Artificial Sequence: Synthetic oligonucleotide"
ugaucuggagcucucgguu

SEQ ID NO: 10597 - RNA, 19 nt, Artificial Sequence
  source: /note="Description of Artificial Sequence: Synthetic oligonucleotide"
gaaaguuagcagagauaaa

SEQ ID NO: 10598 - RNA, 19 nt, Artificial Sequence
  source: /note="Description of Artificial Sequence: Synthetic oligonucleotide"
uuuaucucugcuaacuuuc

SEQ ID NO: 10599 - RNA, 19 nt, Artificial Sequence
  source: /note="Description of Artificial Sequence: Synthetic oligonucleotide"
acaguaguggcaacuccug

SEQ ID NO: 10600 - RNA, 19 nt, Artificial Sequence
  source: /note="Description of Artificial Sequence: Synthetic oligonucleotide"
caggaguugccacuacugu

SEQ ID NO: 10601 - RNA, 19 nt, Artificial Sequence
  source: /note="Description of Artificial Sequence: Synthetic oligonucleotide"
ggaucauuuggugugguau

SEQ ID NO: 10602 - RNA, 19 nt, Artificial Sequence
  source: /note="Description of Artificial Sequence: Synthetic oligonucleotide"
auaccacaccaaaugaucc

SEQ ID NO: 10603 - RNA, 19 nt, Artificial Sequence
  source: /note="Description of Artificial Sequence: Synthetic oligonucleotide"
gaaccgagagcuccagauc

SEQ ID NO: 10604 - RNA, 19 nt, Artificial Sequence
  source: /note="Description of Artificial Sequence: Synthetic oligonucleotide"
gaucuggagcucucgguuc

SEQ ID NO: 10605 - RNA, 19 nt, Artificial Sequence
  source: /note="Description of Artificial Sequence: Synthetic oligonucleotide"
uaccuuaaccuggugcugg

SEQ ID NO: 10606 - RNA, 19 nt, Artificial Sequence
  source: /note="Description of Artificial Sequence: Synthetic oligonucleotide"
ccagcaccagguuaaggua

SEQ ID NO: 10607 - RNA, 19 nt, Artificial Sequence
  source: /note="Description of Artificial Sequence: Synthetic oligonucleotide"
accuuaaccuggugcugga

SEQ ID NO: 10608 - RNA, 19 nt, Artificial Sequence
  source: /note="Description of Artificial Sequence: Synthetic oligonucleotide"
uccagcaccagguuaaggu

SEQ ID NO: 10609 - RNA, 19 nt, Artificial Sequence
  source: /note="Description of Artificial Sequence: Synthetic oligonucleotide"
ccuuaaccuggugcuggac

SEQ ID NO: 10610 - RNA, 19 nt, Artificial Sequence
  source: /note="Description of Artificial Sequence: Synthetic oligonucleotide"
guccagcaccagguuaagg

SEQ ID NO: 10611 - RNA, 19 nt, Artificial Sequence
  source: /note="Description of Artificial Sequence: Synthetic oligonucleotide"
cagcuguucagaagucuag

SEQ ID NO: 10612 - RNA, 19 nt, Artificial Sequence
  source: /note="Description of Artificial Sequence: Synthetic oligonucleotide"
cuagacuucugaacagcug

SEQ ID NO: 10613 - RNA, 19 nt, Artificial Sequence
  source: /note="Description of Artificial Sequence: Synthetic oligonucleotide"
ugccaucgagacauuaaac

SEQ ID NO: 10614 - RNA, 19 nt, Artificial Sequence
  source: /note="Description of Artificial Sequence: Synthetic oligonucleotide"
guuuaaugucucgauggca

SEQ ID NO: 10615 - RNA, 19 nt, Artificial Sequence
  source: /note="Description of Artificial Sequence: Synthetic oligonucleotide"
uauuaaaacucugugacuu

SEQ ID NO: 10616 - RNA, 19 nt, Artificial Sequence
  source: /note="Description of Artificial Sequence: Synthetic oligonucleotide"
aagucacagaguuuuaaua

SEQ ID NO: 10617 - RNA, 19 nt, Artificial Sequence
  source: /note="Description of Artificial Sequence: Synthetic oligonucleotide"
uuuggaagugcaaagcagc

SEQ ID NO: 10618 - RNA, 19 nt, Artificial Sequence
  source: /note="Description of Artificial Sequence: Synthetic oligonucleotide"
gcugcuuugcacuuccaaa

SEQ ID NO: 10619 - RNA, 19 nt, Artificial Sequence
  source: /note="Description of Artificial Sequence: Synthetic oligonucleotide"
ggaagugcaaagcagcugg

SEQ ID NO: 10620 - RNA, 19 nt, Artificial Sequence
  source: /note="Description of Artificial Sequence: Synthetic oligonucleotide"
ccagcugcuuugcacuucc

SEQ ID NO: 10621 - RNA, 19 nt, Artificial Sequence
  source: /note="Description of Artificial Sequence: Synthetic oligonucleotide"
guggaucaguugguggaaa

SEQ ID NO: 10622 - RNA, 19 nt, Artificial Sequence
  source: /note="Description of Artificial Sequence: Synthetic oligonucleotide"
uuuccaccaacugauccac

SEQ ID NO: 10623 - RNA, 19 nt, Artificial Sequence
  source: /note="Description of Artificial Sequence: Synthetic oligonucleotide"
uggaucaguugguggaaau

SEQ ID NO: 10624 - RNA, 19 nt, Artificial Sequence
  source: /note="Description of Artificial Sequence: Synthetic oligonucleotide"
auuuccaccaacugaucca

SEQ ID NO: 10625 - RNA, 19 nt, Artificial Sequence
  source: /note="Description of Artificial Sequence: Synthetic oligonucleotide"
aacaccaacaagggagcaa

SEQ ID NO: 10626 - RNA, 19 nt, Artificial Sequence
  source: /note="Description of Artificial Sequence: Synthetic oligonucleotide"
uugcucccuuguugguguu

SEQ ID NO: 10627 - RNA, 19 nt, Artificial Sequence
  source: /note="Description of Artificial Sequence: Synthetic oligonucleotide"
aaaugaacccaaauuauac

SEQ ID NO: 10628 - RNA, 19 nt, Artificial Sequence
  source: /note="Description of Artificial Sequence: Synthetic oligonucleotide"
guauaauuuggguucauuu

SEQ ID NO: 10629 - RNA, 19 nt, Artificial Sequence
  source: /note="Description of Artificial Sequence: Synthetic oligonucleotide"
aaaggucuuccggccccga

SEQ ID NO: 10630 - RNA, 19 nt, Artificial Sequence
  source: /note="Description of Artificial Sequence: Synthetic oligonucleotide"
ucggggccggaagaccuuu

SEQ ID NO: 10631 - RNA, 19 nt, Artificial Sequence
  source: /note="Description of Artificial Sequence: Synthetic oligonucleotide"
agguaaccacaguaguggc

SEQ ID NO: 10632 - RNA, 19 nt, Artificial Sequence
  source: /note="Description of Artificial Sequence: Synthetic oligonucleotide"
gccacuacugugguuaccu

SEQ ID NO: 10633 - RNA, 19 nt, Artificial Sequence
  source: /note="Description of Artificial Sequence: Synthetic oligonucleotide"
uagccuauauccauuccuu

SEQ ID NO: 10634 - RNA, 19 nt, Artificial Sequence
  source: /note="Description of Artificial Sequence: Synthetic oligonucleotide"
aaggaauggauauaggcua

SEQ ID NO: 10635 - RNA, 19 nt, Artificial Sequence
  source: /note="Description of Artificial Sequence: Synthetic oligonucleotide"
aaaguuagcagagauaaag

SEQ ID NO: 10636 - RNA, 19 nt, Artificial Sequence
  source: /note="Description of Artificial Sequence: Synthetic oligonucleotide"
cuuuaucucugcuaacuuu

SEQ ID NO: 10637 - RNA, 19 nt, Artificial Sequence
  source: /note="Description of Artificial Sequence: Synthetic oligonucleotide"
aaguuagcagagauaaaga

SEQ ID NO: 10638 - RNA, 19 nt, Artificial Sequence
  source: /note="Description of Artificial Sequence: Synthetic oligonucleotide"
ucuuuaucucugcuaacuu

SEQ ID NO: 10639 - RNA, 19 nt, Artificial Sequence
  source: /note="Description of Artificial Sequence: Synthetic oligonucleotide"
guaaccacaguaguggcaa

SEQ ID NO: 10640 - RNA, 19 nt, Artificial Sequence
  source: /note="Description of Artificial Sequence: Synthetic oligonucleotide"
uugccacuacugugguuac

SEQ ID NO: 10641 - RNA, 19 nt, Artificial Sequence
  source: /note="Description of Artificial Sequence: Synthetic oligonucleotide"
aggguccugacaggccaca

SEQ ID NO: 10642 - RNA, 19 nt, Artificial Sequence
  source: /note="Description of Artificial Sequence: Synthetic oligonucleotide"
uguggccugucaggacccu

SEQ ID NO: 10643 - RNA, 19 nt, Artificial Sequence
  source: /note="Description of Artificial Sequence: Synthetic oligonucleotide"
ggguccugacaggccacag

SEQ ID NO: 10644 - RNA, 19 nt, Artificial Sequence
  source: /note="Description of Artificial Sequence: Synthetic oligonucleotide"
cuguggccugucaggaccc

SEQ ID NO: 10645 - RNA, 19 nt, Artificial Sequence
  source: /note="Description of Artificial Sequence: Synthetic oligonucleotide"
gaaagugauuggaaaugga

SEQ ID NO: 10646 - RNA, 19 nt, Artificial Sequence
  source: /note="Description of Artificial Sequence: Synthetic oligonucleotide"
uccauuuccaaucacuuuc

SEQ ID NO: 10647 - RNA, 19 nt, Artificial Sequence
  source: /note="Description of Artificial Sequence: Synthetic oligonucleotide"
gccaucaagaaaguucuac

SEQ ID NO: 10648 - RNA, 19 nt, Artificial Sequence
  source: /note="Description of Artificial Sequence: Synthetic oligonucleotide"
guagaacuuucuugauggc

SEQ ID NO: 10649 - RNA, 19 nt, Artificial Sequence
  source: /note="Description of Artificial Sequence: Synthetic oligonucleotide"
ucaagaaaguucuacagga

SEQ ID NO: 10650 - RNA, 19 nt, Artificial Sequence
  source: /note="Description of Artificial Sequence: Synthetic oligonucleotide"
uccuguagaacuuucuuga

SEQ ID NO: 10651 - RNA, 19 nt, Artificial Sequence
  source: /note="Description of Artificial Sequence: Synthetic oligonucleotide"
ggacaagcgauuuaagaac

SEQ ID NO: 10652 - RNA, 19 nt, Artificial Sequence
  source: /note="Description of Artificial Sequence: Synthetic oligonucleotide"
guucuuaaaucgcuugucc

SEQ ID NO: 10653 - RNA, 19 nt, Artificial Sequence
  source: /note="Description of Artificial Sequence: Synthetic oligonucleotide"
auuuaagaaccgagagcuc

SEQ ID NO: 10654 - RNA, 19 nt, Artificial Sequence
  source: /note="Description of Artificial Sequence: Synthetic oligonucleotide"
gagcucucgguucuuaaau

SEQ ID NO: 10655 - RNA, 19 nt, Artificial Sequence
  source: /note="Description of Artificial Sequence: Synthetic oligonucleotide"
agagcuccagaucaugaga

SEQ ID NO: 10656 - RNA, 19 nt, Artificial Sequence
  source: /note="Description of Artificial Sequence: Synthetic oligonucleotide"
ucucaugaucuggagcucu

SEQ ID NO: 10657 - RNA, 19 nt, Artificial Sequence
  source: /note="Description of Artificial Sequence: Synthetic oligonucleotide"
cugcgguauuucuucuacu

SEQ ID NO: 10658 - RNA, 19 nt, Artificial Sequence
  source: /note="Description of Artificial Sequence: Synthetic oligonucleotide"
aguagaagaaauaccgcag

SEQ ID NO: 10659 - RNA, 19 nt, Artificial Sequence
  source: /note="Description of Artificial Sequence: Synthetic oligonucleotide"
ugcgguauuucuucuacuc

SEQ ID NO: 10660 - RNA, 19 nt, Artificial Sequence
  source: /note="Description of Artificial Sequence: Synthetic oligonucleotide"
gaguagaagaaauaccgca

SEQ ID NO: 10661 - RNA, 19 nt, Artificial Sequence
  source: /note="Description of Artificial Sequence: Synthetic oligonucleotide"
ggucuaccuuaaccuggug

SEQ ID NO: 10662 - RNA, 19 nt, Artificial Sequence
  source: /note="Description of Artificial Sequence: Synthetic oligonucleotide"
caccagguuaagguagacc

SEQ ID NO: 10663 - RNA, 19 nt, Artificial Sequence
  source: /note="Description of Artificial Sequence: Synthetic oligonucleotide"
uaaccuggugcuggacuau

SEQ ID NO: 10664 - RNA, 19 nt, Artificial Sequence
  source: /note="Description of Artificial Sequence: Synthetic oligonucleotide"
auaguccagcaccagguua

SEQ ID NO: 10665 - RNA, 19 nt, Artificial Sequence
  source: /note="Description of Artificial Sequence: Synthetic oligonucleotide"
cucccugugaucuauguca

SEQ ID NO: 10666 - RNA, 19 nt, Artificial Sequence
  source: /note="Description of Artificial Sequence: Synthetic oligonucleotide"
ugacauagaucacagggag

SEQ ID NO: 10667 - RNA, 19 nt, Artificial Sequence
  source: /note="Description of Artificial Sequence: Synthetic oligonucleotide"
cuuuggaagugcaaagcag

SEQ ID NO: 10668 - RNA, 19 nt, Artificial Sequence
  source: /note="Description of Artificial Sequence: Synthetic oligonucleotide"
cugcuuugcacuuccaaag

SEQ ID NO: 10669 - RNA, 19 nt, Artificial Sequence
  source: /note="Description of Artificial Sequence: Synthetic oligonucleotide"
aaagcagcugguccgagga

SEQ ID NO: 10670 - RNA, 19 nt, Artificial Sequence
  source: /note="Description of Artificial Sequence: Synthetic oligonucleotide"
uccucggaccagcugcuuu

SEQ ID NO: 10671 - RNA, 19 nt, Artificial Sequence
  source: /note="Description of Artificial Sequence: Synthetic oligonucleotide"
gagcccaauguuucauaua

SEQ ID NO: 10672 - RNA, 19 nt, Artificial Sequence
  source: /note="Description of Artificial Sequence: Synthetic oligonucleotide"
uauaugaaacauugggcuc

SEQ ID NO: 10673 - RNA, 19 nt, Artificial Sequence
  source: /note="Description of Artificial Sequence: Synthetic oligonucleotide"
aucuguucucgguacuaca

SEQ ID NO: 10674 - RNA, 19 nt, Artificial Sequence
  source: /note="Description of Artificial Sequence: Synthetic oligonucleotide"
uguaguaccgagaacagau

SEQ ID NO: 10675 - RNA, 19 nt, Artificial Sequence
  source: /note="Description of Artificial Sequence: Synthetic oligonucleotide"
aggacaaccaauauuuccu

SEQ ID NO: 10676 - RNA, 19 nt, Artificial Sequence
  source: /note="Description of Artificial Sequence: Synthetic oligonucleotide"
aggaaauauugguuguccu

SEQ ID NO: 10677 - RNA, 19 nt, Artificial Sequence
  source: /note="Description of Artificial Sequence: Synthetic oligonucleotide"
ggacaaccaauauuuccug

SEQ ID NO: 10678 - RNA, 19 nt, Artificial Sequence
  source: /note="Description of Artificial Sequence: Synthetic oligonucleotide"
caggaaauauugguugucc

SEQ ID NO: 10679 - RNA, 19 nt, Artificial Sequence
  source: /note="Description of Artificial Sequence: Synthetic oligonucleotide"
ucaguugguggaaauaaua

SEQ ID NO: 10680 - RNA, 19 nt, Artificial Sequence
  source: /note="Description of Artificial Sequence: Synthetic oligonucleotide"
uauuauuuccaccaacuga

SEQ ID NO: 10681 - RNA, 19 nt, Artificial Sequence
  source: /note="Description of Artificial Sequence: Synthetic oligonucleotide"
gaacaccaacaagggagca

SEQ ID NO: 10682 - RNA, 19 nt, Artificial Sequence
  source: /note="Description of Artificial Sequence: Synthetic oligonucleotide"
ugcucccuuguugguguuc

SEQ ID NO: 10683 - RNA, 19 nt, Artificial Sequence
  source: /note="Description of Artificial Sequence: Synthetic oligonucleotide"
auucccucaaaucaaggca

SEQ ID NO: 10684 - RNA, 19 nt, Artificial Sequence
  source: /note="Description of Artificial Sequence: Synthetic oligonucleotide"
ugccuugauuugagggaau

SEQ ID NO: 10685 - RNA, 19 nt, Artificial Sequence
  source: /note="Description of Artificial Sequence: Synthetic oligonucleotide"
uucccucaaaucaaggcac

SEQ ID NO: 10686 - RNA, 19 nt, Artificial Sequence
  source: /note="Description of Artificial Sequence: Synthetic oligonucleotide"
gugccuugauuugagggaa

SEQ ID NO: 10687 - RNA, 19 nt, Artificial Sequence
  source: /note="Description of Artificial Sequence: Synthetic oligonucleotide"
caauugcacugugcagccg

SEQ ID NO: 10688 - RNA, 19 nt, Artificial Sequence
  source: /note="Description of Artificial Sequence: Synthetic oligonucleotide"
cggcugcacagugcaauug

SEQ ID NO: 10689 - RNA, 19 nt, Artificial Sequence
  source: /note="Description of Artificial Sequence: Synthetic oligonucleotide"
accgagaaccaccuccuuu

SEQ ID NO: 10690 - RNA, 19 nt, Artificial Sequence
  source: /note="Description of Artificial Sequence: Synthetic oligonucleotide"
aaaggaggugguucucggu

SEQ ID NO: 10691 - RNA, 19 nt, Artificial Sequence
  source: /note="Description of Artificial Sequence: Synthetic oligonucleotide"
uugcggagagcugcaagcc

SEQ ID NO: 10692 - RNA, 19 nt, Artificial Sequence
  source: /note="Description of Artificial Sequence: Synthetic oligonucleotide"
ggcuugcagcucuccgcaa

SEQ ID NO: 10693 - RNA, 19 nt, Artificial Sequence
  source: /note="Description of Artificial Sequence: Synthetic oligonucleotide"
ugcggagagcugcaagcca

SEQ ID NO: 10694 - RNA, 19 nt, Artificial Sequence
  source: /note="Description of Artificial Sequence: Synthetic oligonucleotide"
uggcuugcagcucuccgca

SEQ ID NO: 10695 - RNA, 19 nt, Artificial Sequence
  source: /note="Description of Artificial Sequence: Synthetic oligonucleotide"
agcugcaagccagugcagc

SEQ ID NO: 10696 - RNA, 19 nt, Artificial Sequence
  source: /note="Description of Artificial Sequence: Synthetic oligonucleotide"
gcugcacuggcuugcagcu

SEQ ID NO: 10697 - RNA, 19 nt, Artificial Sequence
  source: /note="Description of Artificial Sequence: Synthetic oligonucleotide"
gcugcaagccagugcagca

SEQ ID NO: 10698 - RNA, 19 nt, Artificial Sequence
  source: /note="Description of Artificial Sequence: Synthetic oligonucleotide"
ugcugcacuggcuugcagc

SEQ ID NO: 10699 - RNA, 19 nt, Artificial Sequence
  source: /note="Description of Artificial Sequence: Synthetic oligonucleotide"
gccagugcagcagccuuca

SEQ ID NO: 10700 - RNA, 19 nt, Artificial Sequence
  source: /note="Description of Artificial Sequence: Synthetic oligonucleotide"
ugaaggcugcugcacuggc

SEQ ID NO: 10701 - RNA, 19 nt, Artificial Sequence
  source: /note="Description of Artificial Sequence: Synthetic oligonucleotide"
ccagugcagcagccuucag

SEQ ID NO: 10702 - RNA, 19 nt, Artificial Sequence
  source: /note="Description of Artificial Sequence: Synthetic oligonucleotide"
cugaaggcugcugcacugg

SEQ ID NO: 10703 - RNA, 19 nt, Artificial Sequence
  source: /note="Description of Artificial Sequence: Synthetic oligonucleotide"
gcuuuugguagcaugaaag

SEQ ID NO: 10704 - RNA, 19 nt, Artificial Sequence
  source: /note="Description of Artificial Sequence: Synthetic oligonucleotide"
cuuucaugcuaccaaaagc

SEQ ID NO: 10705 - RNA, 19 nt, Artificial Sequence
  source: /note="Description of Artificial Sequence: Synthetic oligonucleotide"
gguagcaugaaaguuagca

SEQ ID NO: 10706 - RNA, 19 nt, Artificial Sequence
  source: /note="Description of Artificial Sequence: Synthetic oligonucleotide"
ugcuaacuuucaugcuacc

SEQ ID NO: 10707 - RNA, 19 nt, Artificial Sequence
  source: /note="Description of Artificial Sequence: Synthetic oligonucleotide"
guagcaugaaaguuagcag

SEQ ID NO: 10708 - RNA, 19 nt, Artificial Sequence
  source: /note="Description of Artificial Sequence: Synthetic oligonucleotide"
cugcuaacuuucaugcuac

SEQ ID NO: 10709 - RNA, 19 nt, Artificial Sequence
  source: /note="Description of Artificial Sequence: Synthetic oligonucleotide"
uagcaugaaaguuagcaga

SEQ ID NO: 10710 - RNA, 19 nt, Artificial Sequence
  source: /note="Description of Artificial Sequence: Synthetic oligonucleotide"
ucugcuaacuuucaugcua

SEQ ID NO: 10711 - RNA, 19 nt, Artificial Sequence
  source: /note="Description of Artificial Sequence: Synthetic oligonucleotide"
aguuagcagagauaaagau

SEQ ID NO: 10712 - RNA, 19 nt, Artificial Sequence
  source: /note="Description of Artificial Sequence: Synthetic oligonucleotide"
aucuuuaucucugcuaacu

SEQ ID NO: 10713 - RNA, 19 nt, Artificial Sequence
  source: /note="Description of Artificial Sequence: Synthetic oligonucleotide"
guuagcagagauaaagaug

SEQ ID NO: 10714 - RNA, 19 nt, Artificial Sequence
  source: /note="Description of Artificial Sequence: Synthetic oligonucleotide"
caucuuuaucucugcuaac

SEQ ID NO: 10715 - RNA, 19 nt, Artificial Sequence
  source: /note="Description of Artificial Sequence: Synthetic oligonucleotide"
uuagcagagauaaagaugg

SEQ ID NO: 10716 - RNA, 19 nt, Artificial Sequence
  source: /note="Description of Artificial Sequence: Synthetic oligonucleotide"
ccaucuuuaucucugcuaa

SEQ ID NO: 10717 - RNA, 19 nt, Artificial Sequence
  source: /note="Description of Artificial Sequence: Synthetic oligonucleotide"
gauaaagauggcagcaagg

SEQ ID NO: 10718 - RNA, 19 nt, Artificial Sequence
  source: /note="Description of Artificial Sequence: Synthetic oligonucleotide"
ccuugcugccaucuuuauc

SEQ ID NO: 10719 - RNA, 19 nt, Artificial Sequence
  source: /note="Description of Artificial Sequence: Synthetic oligonucleotide"
auaaagauggcagcaaggu

SEQ ID NO: 10720 - RNA, 19 nt, Artificial Sequence
  source: /note="Description of Artificial Sequence: Synthetic oligonucleotide"
accuugcugccaucuuuau

SEQ ID NO: 10721 - RNA, 19 nt, Artificial Sequence
  source: /note="Description of Artificial Sequence: Synthetic oligonucleotide"
ccacaguaguggcaacucc

SEQ ID NO: 10722 - RNA, 19 nt, Artificial Sequence
  source: /note="Description of Artificial Sequence: Synthetic oligonucleotide"
ggaguugccacuacugugg

SEQ ID NO: 10723 - RNA, 19 nt, Artificial Sequence
  source: /note="Description of Artificial Sequence: Synthetic oligonucleotide"
uggcaacuccuggccaggg

SEQ ID NO: 10724 - RNA, 19 nt, Artificial Sequence
  source: /note="Description of Artificial Sequence: Synthetic oligonucleotide"
cccuggccaggaguugcca

SEQ ID NO: 10725 - RNA, 19 nt, Artificial Sequence
  source: /note="Description of Artificial Sequence: Synthetic oligonucleotide"
uggccaggguccugacagg

SEQ ID NO: 10726 - RNA, 19 nt, Artificial Sequence
  source: /note="Description of Artificial Sequence: Synthetic oligonucleotide"
ccugucaggacccuggcca

SEQ ID NO: 10727 - RNA, 19 nt, Artificial Sequence
  source: /note="Description of Artificial Sequence: Synthetic oligonucleotide"
ccaggguccugacaggcca

SEQ ID NO: 10728 - RNA, 19 nt, Artificial Sequence
  source: /note="Description of Artificial Sequence: Synthetic oligonucleotide"
uggccugucaggacccugg

SEQ ID NO: 10729 - RNA, 19 nt, Artificial Sequence
  source: /note="Description of Artificial Sequence: Synthetic oligonucleotide"
gguccugacaggccacagg

SEQ ID NO: 10730 - RNA, 19 nt, Artificial Sequence
  source: /note="Description of Artificial Sequence: Synthetic oligonucleotide"
ccuguggccugucaggacc

SEQ ID NO: 10731 - RNA, 19 nt, Artificial Sequence
  source: /note="Description of Artificial Sequence: Synthetic oligonucleotide"
cugacaggccacaggaagu

SEQ ID NO: 10732 - RNA, 19 nt, Artificial Sequence
  source: /note="Description of Artificial Sequence: Synthetic oligonucleotide"
acuuccuguggccugucag

SEQ ID NO: 10733 - RNA, 19 nt, Artificial Sequence
  source: /note="Description of Artificial Sequence: Synthetic oligonucleotide"
auacagacacgaaagugau

SEQ ID NO: 10734 - RNA, 19 nt, Artificial Sequence
  source: /note="Description of Artificial Sequence: Synthetic oligonucleotide"
aucacuuucgugucuguau

SEQ ID NO: 10735 - RNA, 19 nt, Artificial Sequence
  source: /note="Description of Artificial Sequence: Synthetic oligonucleotide"
acagacacgaaagugauug

SEQ ID NO: 10736 - RNA, 19 nt, Artificial Sequence
  source: /note="Description of Artificial Sequence: Synthetic oligonucleotide"
caaucacuuucgugucugu

SEQ ID NO: 10737 - RNA, 19 nt, Artificial Sequence
  source: /note="Description of Artificial Sequence: Synthetic oligonucleotide"
auggaucauuugguguggu

SEQ ID NO: 10738 - RNA, 19 nt, Artificial Sequence
  source: /note="Description of Artificial Sequence: Synthetic oligonucleotide"
accacaccaaaugauccau

SEQ ID NO: 10739 - RNA, 19 nt, Artificial Sequence
  source: /note="Description of Artificial Sequence: Synthetic oligonucleotide"
gugguauaucaagccaaac

SEQ ID NO: 10740 - RNA, 19 nt, Artificial Sequence
  source: /note="Description of Artificial Sequence: Synthetic oligonucleotide"
guuuggcuugauauaccac

SEQ ID NO: 10741 - RNA, 19 nt, Artificial Sequence
  source: /note="Description of Artificial Sequence: Synthetic oligonucleotide"
aacugguugccaucaagaa

SEQ ID NO: 10742 - RNA, 19 nt, Artificial Sequence
  source: /note="Description of Artificial Sequence: Synthetic oligonucleotide"
uucuugauggcaaccaguu

SEQ ID NO: 10743 - RNA, 19 nt, Artificial Sequence
  source: /note="Description of Artificial Sequence: Synthetic oligonucleotide"
acugguugccaucaagaaa

SEQ ID NO: 10744 - RNA, 19 nt, Artificial Sequence
  source: /note="Description of Artificial Sequence: Synthetic oligonucleotide"
uuucuugauggcaaccagu

SEQ ID NO: 10745 - RNA, 19 nt, Artificial Sequence
  source: /note="Description of Artificial Sequence: Synthetic oligonucleotide"
cugguugccaucaagaaag

SEQ ID NO: 10746 - RNA, 19 nt, Artificial Sequence
  source: /note="Description of Artificial Sequence: Synthetic oligonucleotide"
cuuucuugauggcaaccag

SEQ ID NO: 10747 - RNA, 19 nt, Artificial Sequence
  source: /note="Description of Artificial Sequence: Synthetic oligonucleotide"
ugccaucaagaaaguucua

SEQ ID NO: 10748 - RNA, 19 nt, Artificial Sequence
  source: /note="Description of Artificial Sequence: Synthetic oligonucleotide"
uagaacuuucuugauggca

SEQ ID NO: 10749 - RNA, 19 nt, Artificial Sequence
  source: /note="Description of Artificial Sequence: Synthetic oligonucleotide"
caagaaaguucuacaggac

SEQ ID NO: 10750 - RNA, 19 nt, Artificial Sequence
  source: /note="Description of Artificial Sequence: Synthetic oligonucleotide"
guccuguagaacuuucuug

SEQ ID NO: 10751 - RNA, 19 nt, Artificial Sequence
  source: /note="Description of Artificial Sequence: Synthetic oligonucleotide"
cgagagcuccagaucauga

SEQ ID NO: 10752 - RNA, 19 nt, Artificial Sequence
  source: /note="Description of Artificial Sequence: Synthetic oligonucleotide"
ucaugaucuggagcucucg

SEQ ID NO: 10753 - RNA, 19 nt, Artificial Sequence
  source: /note="Description of Artificial Sequence: Synthetic oligonucleotide"
gagcuccagaucaugagaa

SEQ ID NO: 10754 - RNA, 19 nt, Artificial Sequence
  source: /note="Description of Artificial Sequence: Synthetic oligonucleotide"
uucucaugaucuggagcuc

SEQ ID NO: 10755 - RNA, 19 nt, Artificial Sequence
  source: /note="Description of Artificial Sequence: Synthetic oligonucleotide"
cuagaccacuguaacauag

SEQ ID NO: 10756 - RNA, 19 nt, Artificial Sequence
  source: /note="Description of Artificial Sequence: Synthetic oligonucleotide"
cuauguuacaguggucuag

SEQ ID NO: 10757 - RNA, 19 nt, Artificial Sequence
  source: /note="Description of Artificial Sequence: Synthetic oligonucleotide"
guggugagaagaaagauga

SEQ ID NO: 10758 - RNA, 19 nt, Artificial Sequence
  source: /note="Description of Artificial Sequence: Synthetic oligonucleotide"
ucaucuuucuucucaccac

SEQ ID NO: 10759 - RNA, 19 nt, Artificial Sequence
  source: /note="Description of Artificial Sequence: Synthetic oligonucleotide"
uggugagaagaaagaugag

SEQ ID NO: 10760 - RNA, 19 nt, Artificial Sequence
  source: /note="Description of Artificial Sequence: Synthetic oligonucleotide"
cucaucuuucuucucacca

SEQ ID NO: 10761 - RNA, 19 nt, Artificial Sequence
  source: /note="Description of Artificial Sequence: Synthetic oligonucleotide"
ucuaccuuaaccuggugcu

SEQ ID NO: 10762 - RNA, 19 nt, Artificial Sequence
  source: /note="Description of Artificial Sequence: Synthetic oligonucleotide"
agcaccagguuaagguaga

SEQ ID NO: 10763 - RNA, 19 nt, Artificial Sequence
  source: /note="Description of Artificial Sequence: Synthetic oligonucleotide"
uggugcuggacuauguucc

SEQ ID NO: 10764 - RNA, 19 nt, Artificial Sequence
  source: /note="Description of Artificial Sequence: Synthetic oligonucleotide"
ggaacauaguccagcacca

SEQ ID NO: 10765 - RNA, 19 nt, Artificial Sequence
  source: /note="Description of Artificial Sequence: Synthetic oligonucleotide"
cggagacaguguacagagu

SEQ ID NO: 10766 - RNA, 19 nt, Artificial Sequence
  source: /note="Description of Artificial Sequence: Synthetic oligonucleotide"
acucuguacacugucuccg

SEQ ID NO: 10767 - RNA, 19 nt, Artificial Sequence
  source: /note="Description of Artificial Sequence: Synthetic oligonucleotide"
gagccaagcagacacuccc

SEQ ID NO: 10768 - RNA, 19 nt, Artificial Sequence
  source: /note="Description of Artificial Sequence: Synthetic oligonucleotide"
gggagugucugcuuggcuc

SEQ ID NO: 10769 - RNA, 19 nt, Artificial Sequence
  source: /note="Description of Artificial Sequence: Synthetic oligonucleotide"
agccaagcagacacucccu

SEQ ID NO: 10770 - RNA, 19 nt, Artificial Sequence
  source: /note="Description of Artificial Sequence: Synthetic oligonucleotide"
agggagugucugcuuggcu

SEQ ID NO: 10771 - RNA, 19 nt, Artificial Sequence
  source: /note="Description of Artificial Sequence: Synthetic oligonucleotide"
cagacacucccugugaucu

SEQ ID NO: 10772 - RNA, 19 nt, Artificial Sequence
  source: /note="Description of Artificial Sequence: Synthetic oligonucleotide"
agaucacagggagugucug

SEQ ID NO: 10773 - RNA, 19 nt, Artificial Sequence
  source: /note="Description of Artificial Sequence: Synthetic oligonucleotide"
guuguauauguaucagcug

SEQ ID NO: 10774 - RNA, 19 nt, Artificial Sequence
  source: /note="Description of Artificial Sequence: Synthetic oligonucleotide"
cagcugauacauauacaac

SEQ ID NO: 10775 - RNA, 19 nt, Artificial Sequence
  source: /note="Description of Artificial Sequence: Synthetic oligonucleotide"
aucagcuguucagaagucu

SEQ ID NO: 10776 - RNA, 19 nt, Artificial Sequence
  source: /note="Description of Artificial Sequence: Synthetic oligonucleotide"
agacuucugaacagcugau

SEQ ID NO: 10777 - RNA, 19 nt, Artificial Sequence
  source: /note="Description of Artificial Sequence: Synthetic oligonucleotide"
ucagcuguucagaagucua

SEQ ID NO: 10778 - RNA, 19 nt, Artificial Sequence
  source: /note="Description of Artificial Sequence: Synthetic oligonucleotide"
uagacuucugaacagcuga

SEQ ID NO: 10779 - RNA, 19 nt, Artificial Sequence
  source: /note="Description of Artificial Sequence: Synthetic oligonucleotide"
agccuauauccauuccuuu

SEQ ID NO: 10780 - RNA, 19 nt, Artificial Sequence
  source: /note="Description of Artificial Sequence: Synthetic oligonucleotide"
aaaggaauggauauaggcu

SEQ ID NO: 10781 - RNA, 19 nt, Artificial Sequence
  source: /note="Description of Artificial Sequence: Synthetic oligonucleotide"
gccuauauccauuccuuug

SEQ ID NO: 10782 - RNA, 19 nt, Artificial Sequence
  source: /note="Description of Artificial Sequence: Synthetic oligonucleotide"
caaaggaauggauauaggc

SEQ ID NO: 10783 - RNA, 19 nt, Artificial Sequence
  source: /note="Description of Artificial Sequence: Synthetic oligonucleotide"
ccuauauccauuccuuugg

SEQ ID NO: 10784 - RNA, 19 nt, Artificial Sequence
  source: /note="Description of Artificial Sequence: Synthetic oligonucleotide"
ccaaaggaauggauauagg

SEQ ID NO: 10785 - RNA, 19 nt, Artificial Sequence
  source: /note="Description of Artificial Sequence: Synthetic oligonucleotide"
auauccauuccuuuggaau

SEQ ID NO: 10786 - RNA, 19 nt, Artificial Sequence
  source: /note="Description of Artificial Sequence: Synthetic oligonucleotide"
auuccaaaggaauggauau

SEQ ID NO: 10787 - RNA, 19 nt, Artificial Sequence
  source: /note="Description of Artificial Sequence: Synthetic oligonucleotide"
uauccauuccuuuggaauc

SEQ ID NO: 10788 - RNA, 19 nt, Artificial Sequence
  source: /note="Description of Artificial Sequence: Synthetic oligonucleotide"
gauuccaaaggaauggaua

SEQ ID NO: 10789 - RNA, 19 nt, Artificial Sequence
  source: /note="Description of Artificial Sequence: Synthetic oligonucleotide"
ccauuccuuuggaaucugc

SEQ ID NO: 10790 - RNA, 19 nt, Artificial Sequence
  source: /note="Description of Artificial Sequence: Synthetic oligonucleotide"
gcagauuccaaaggaaugg

SEQ ID NO: 10791 - RNA, 19 nt, Artificial Sequence
  source: /note="Description of Artificial Sequence: Synthetic oligonucleotide"
uccuuuggaaucugccauc

SEQ ID NO: 10792 - RNA, 19 nt, Artificial Sequence
  source: /note="Description of Artificial Sequence: Synthetic oligonucleotide"
gauggcagauuccaaagga

SEQ ID NO: 10793 - RNA, 19 nt, Artificial Sequence
  source: /note="Description of Artificial Sequence: Synthetic oligonucleotide"
auuaaaccacagaaccucu

SEQ ID NO: 10794 - RNA, 19 nt, Artificial Sequence
  source: /note="Description of Artificial Sequence: Synthetic oligonucleotide"
agagguucugugguuuaau

SEQ ID NO: 10795 - RNA, 19 nt, Artificial Sequence
  source: /note="Description of Artificial Sequence: Synthetic oligonucleotide"
auuaaaacucugugacuuu

SEQ ID NO: 10796 - RNA, 19 nt, Artificial Sequence
  source: /note="Description of Artificial Sequence: Synthetic oligonucleotide"
aaagucacagaguuuuaau

SEQ ID NO: 10797 - RNA, 19 nt, Artificial Sequence
  source: /note="Description of Artificial Sequence: Synthetic oligonucleotide"
uuaaaacucugugacuuug

SEQ ID NO: 10798 - RNA, 19 nt, Artificial Sequence
  source: /note="Description of Artificial Sequence: Synthetic oligonucleotide"
caaagucacagaguuuuaa

SEQ ID NO: 10799 - RNA, 19 nt, Artificial Sequence
  source: /note="Description of Artificial Sequence: Synthetic oligonucleotide"
aaacucugugacuuuggaa

SEQ ID NO: 10800 - RNA, 19 nt, Artificial Sequence
  source: /note="Description of Artificial Sequence: Synthetic oligonucleotide"
uuccaaagucacagaguuu

SEQ ID NO: 10801 - RNA, 19 nt, Artificial Sequence
  source: /note="Description of Artificial Sequence: Synthetic oligonucleotide"
gugacuuuggaagugcaaa

SEQ ID NO: 10802 - RNA, 19 nt, Artificial Sequence
  source: /note="Description of Artificial Sequence: Synthetic oligonucleotide"
uuugcacuuccaaagucac

SEQ ID NO: 10803 - RNA, 19 nt, Artificial Sequence
  source: /note="Description of Artificial Sequence: Synthetic oligonucleotide"
ugacuuuggaagugcaaag

SEQ ID NO: 10804 - RNA, 19 nt, Artificial Sequence
  source: /note="Description of Artificial Sequence: Synthetic oligonucleotide"
cuuugcacuuccaaaguca

SEQ ID NO: 10805 - RNA, 19 nt, Artificial Sequence
  source: /note="Description of Artificial Sequence: Synthetic oligonucleotide"
uuggaagugcaaagcagcu

SEQ ID NO: 10806 - RNA, 19 nt, Artificial Sequence
  source: /note="Description of Artificial Sequence: Synthetic oligonucleotide"
agcugcuuugcacuuccaa

SEQ ID NO: 10807 - RNA, 19 nt, Artificial Sequence
  source: /note="Description of Artificial Sequence: Synthetic oligonucleotide"
uggaagugcaaagcagcug

SEQ ID NO: 10808 - RNA, 19 nt, Artificial Sequence
  source: /note="Description of Artificial Sequence: Synthetic oligonucleotide"
cagcugcuuugcacuucca

SEQ ID NO: 10809 - RNA, 19 nt, Artificial Sequence
  source: /note="Description of Artificial Sequence: Synthetic oligonucleotide"
gaagugcaaagcagcuggu

SEQ ID NO: 10810 - RNA, 19 nt, Artificial Sequence
  source: /note="Description of Artificial Sequence: Synthetic oligonucleotide"
accagcugcuuugcacuuc

SEQ ID NO: 10811 - RNA, 19 nt, Artificial Sequence
  source: /note="Description of Artificial Sequence: Synthetic oligonucleotide"
cugguccgaggagagccca

SEQ ID NO: 10812 - RNA, 19 nt, Artificial Sequence
  source: /note="Description of Artificial Sequence: Synthetic oligonucleotide"
ugggcucuccucggaccag

SEQ ID NO: 10813 - RNA, 19 nt, Artificial Sequence
  source: /note="Description of Artificial Sequence: Synthetic oligonucleotide"
ugguccgaggagagcccaa

SEQ ID NO: 10814 - RNA, 19 nt, Artificial Sequence
  source: /note="Description of Artificial Sequence: Synthetic oligonucleotide"
uugggcucuccucggacca

SEQ ID NO: 10815 - RNA, 19 nt, Artificial Sequence
  source: /note="Description of Artificial Sequence: Synthetic oligonucleotide"
aggagagcccaauguuuca

SEQ ID NO: 10816 - RNA, 19 nt, Artificial Sequence
  source: /note="Description of Artificial Sequence: Synthetic oligonucleotide"
ugaaacauugggcucuccu

SEQ ID NO: 10817 - RNA, 19 nt, Artificial Sequence
  source: /note="Description of Artificial Sequence: Synthetic oligonucleotide"
uaucuguucucgguacuac

SEQ ID NO: 10818 - RNA, 19 nt, Artificial Sequence
  source: /note="Description of Artificial Sequence: Synthetic oligonucleotide"
guaguaccgagaacagaua

SEQ ID NO: 10819 - RNA, 19 nt, Artificial Sequence
  source: /note="Description of Artificial Sequence: Synthetic oligonucleotide"
uauggucugcaggcugugu

SEQ ID NO: 10820 - RNA, 19 nt, Artificial Sequence
  source: /note="Description of Artificial Sequence: Synthetic oligonucleotide"
acacagccugcagaccaua

SEQ ID NO: 10821 - RNA, 19 nt, Artificial Sequence
  source: /note="Description of Artificial Sequence: Synthetic oligonucleotide"
auuuccuggggacaguggu

SEQ ID NO: 10822 - RNA, 19 nt, Artificial Sequence
  source: /note="Description of Artificial Sequence: Synthetic oligonucleotide"
accacuguccccaggaaau

SEQ ID NO: 10823 - RNA, 19 nt, Artificial Sequence
  source: /note="Description of Artificial Sequence: Synthetic oligonucleotide"
uccuggggacaguggugug

SEQ ID NO: 10824 - RNA, 19 nt, Artificial Sequence
  source: /note="Description of Artificial Sequence: Synthetic oligonucleotide"
cacaccacuguccccagga

SEQ ID NO: 10825 - RNA, 19 nt, Artificial Sequence
  source: /note="Description of Artificial Sequence: Synthetic oligonucleotide"
ccuggggacaguggugugg

SEQ ID NO: 10826 - RNA, 19 nt, Artificial Sequence
  source: /note="Description of Artificial Sequence: Synthetic oligonucleotide"
ccacaccacuguccccagg

SEQ ID NO: 10827 - RNA, 19 nt, Artificial Sequence
  source: /note="Description of Artificial Sequence: Synthetic oligonucleotide"
guugguggaaauaauaaag

SEQ ID NO: 10828 - RNA, 19 nt, Artificial Sequence
  source: /note="Description of Artificial Sequence: Synthetic oligonucleotide"
cuuuauuauuuccaccaac

SEQ ID NO: 10829 - RNA, 19 nt, Artificial Sequence
  source: /note="Description of Artificial Sequence: Synthetic oligonucleotide"
uugguggaaauaauaaagg

SEQ ID NO: 10830 - RNA, 19 nt, Artificial Sequence
  source: /note="Description of Artificial Sequence: Synthetic oligonucleotide"
ccuuuauuauuuccaccaa

SEQ ID NO: 10831 - RNA, 19 nt, Artificial Sequence
  source: /note="Description of Artificial Sequence: Synthetic oligonucleotide"
ugguggaaauaauaaaggu

SEQ ID NO: 10832 - RNA, 19 nt, Artificial Sequence
  source: /note="Description of Artificial Sequence: Synthetic oligonucleotide"
accuuuauuauuuccacca

SEQ ID NO: 10833 - RNA, 19 nt, Artificial Sequence
  source: /note="Description of Artificial Sequence: Synthetic oligonucleotide"
acaccaacaagggagcaaa

SEQ ID NO: 10834 - RNA, 19 nt, Artificial Sequence
  source: /note="Description of Artificial Sequence: Synthetic oligonucleotide"
uuugcucccuuguuggugu

SEQ ID NO: 10835 - RNA, 19 nt, Artificial Sequence
  source: /note="Description of Artificial Sequence: Synthetic oligonucleotide"
caccaacaagggagcaaau

SEQ ID NO: 10836 - RNA, 19 nt, Artificial Sequence
  source: /note="Description of Artificial Sequence: Synthetic oligonucleotide"
auuugcucccuuguuggug

SEQ ID NO: 10837 - RNA, 19 nt, Artificial Sequence
  source: /note="Description of Artificial Sequence: Synthetic oligonucleotide"
uacagaauucaaauucccu

SEQ ID NO: 10838 - RNA, 19 nt, Artificial Sequence
  source: /note="Description of Artificial Sequence: Synthetic oligonucleotide"
agggaauuugaauucugua

SEQ ID NO: 10839 - RNA, 19 nt, Artificial Sequence
  source: /note="Description of Artificial Sequence: Synthetic oligonucleotide"
aaggcacauccuuggacaa

SEQ ID NO: 10840 - RNA, 19 nt, Artificial Sequence
  source: /note="Description of Artificial Sequence: Synthetic oligonucleotide"
uuguccaaggaugugccuu

SEQ ID NO: 10841 - RNA, 19 nt, Artificial Sequence
  source: /note="Description of Artificial Sequence: Synthetic oligonucleotide"
acauccuuggacaaagguc

SEQ ID NO: 10842 - RNA, 19 nt, Artificial Sequence
  source: /note="Description of Artificial Sequence: Synthetic oligonucleotide"
gaccuuuguccaaggaugu

SEQ ID NO: 10843 - RNA, 19 nt, Artificial Sequence
  source: /note="Description of Artificial Sequence: Synthetic oligonucleotide"
acaaaggucuuccggcccc

SEQ ID NO: 10844 - RNA, 19 nt, Artificial Sequence
  source: /note="Description of Artificial Sequence: Synthetic oligonucleotide"
ggggccggaagaccuuugu

SEQ ID NO: 10845 - RNA, 19 nt, Artificial Sequence
  source: /note="Description of Artificial Sequence: Synthetic oligonucleotide"
aggcaauugcacugugcag

SEQ ID NO: 10846 - RNA, 19 nt, Artificial Sequence
  source: /note="Description of Artificial Sequence: Synthetic oligonucleotide"
cugcacagugcaauugccu

SEQ ID NO: 10847 - RNA, 19 nt, Artificial Sequence
  source: /note="Description of Artificial Sequence: Synthetic oligonucleotide"
ugcagccgucugcuggagu

SEQ ID NO: 10848 - RNA, 19 nt, Artificial Sequence
  source: /note="Description of Artificial Sequence: Synthetic oligonucleotide"
acuccagcagacggcugca

SEQ ID NO: 10849 - RNA, 19 nt, Artificial Sequence
  source: /note="Description of Artificial Sequence: Synthetic oligonucleotide"
cgucugcuggaguacacac

SEQ ID NO: 10850 - RNA, 19 nt, Artificial Sequence
  source: /note="Description of Artificial Sequence: Synthetic oligonucleotide"
guguguacuccagcagacg

SEQ ID NO: 10851 - RNA, 19 nt, Artificial Sequence
  source: /note="Description of Artificial Sequence: Synthetic oligonucleotide"
gucugcuggaguacacacc

SEQ ID NO: 10852 - RNA, 19 nt, Artificial Sequence
  source: /note="Description of Artificial Sequence: Synthetic oligonucleotide"
gguguguacuccagcagac

SEQ ID NO: 10853 - RNA, 19 nt, Artificial Sequence
  source: /note="Description of Artificial Sequence: Synthetic oligonucleotide"
uaacaccacuggaagcuug

SEQ ID NO: 10854 - RNA, 19 nt, Artificial Sequence
  source: /note="Description of Artificial Sequence: Synthetic oligonucleotide"
caagcuuccagugguguua

SEQ ID NO: 10855 - RNA, 19 nt, Artificial Sequence
  source: /note="Description of Artificial Sequence: Synthetic oligonucleotide"
gagaaccaccuccuuugcg

SEQ ID NO: 10856 - RNA, 19 nt, Artificial Sequence
  source: /note="Description of Artificial Sequence: Synthetic oligonucleotide"
cgcaaaggaggugguucuc

SEQ ID NO: 10857 - RNA, 19 nt, Artificial Sequence
  source: /note="Description of Artificial Sequence: Synthetic oligonucleotide"
ggugagaagaaagaugagg

SEQ ID NO: 10858 - RNA, 19 nt, Artificial Sequence
  source: /note="Description of Artificial Sequence: Synthetic oligonucleotide"
ccucaucuuucuucucacc

SEQ ID NO: 10859 - RNA, 19 nt, Artificial Sequence
  source: /note="Description of Artificial Sequence: Synthetic oligonucleotide"
uuccuuuggaaucugccau

SEQ ID NO: 10860 - RNA, 19 nt, Artificial Sequence
  source: /note="Description of Artificial Sequence: Synthetic oligonucleotide"
auggcagauuccaaaggaa

SEQ ID NO: 10861 - RNA, 19 nt, Artificial Sequence
  source: /note="Description of Artificial Sequence: Synthetic oligonucleotide"
ugaucuuuggagccacuga

SEQ ID NO: 10862 - RNA, 19 nt, Artificial Sequence
  source: /note="Description of Artificial Sequence: Synthetic oligonucleotide"
ucaguggcuccaaagauca

SEQ ID NO: 10863 - RNA, 19 nt, Artificial Sequence
  source: /note="Description of Artificial Sequence: Synthetic oligonucleotide"
uaauaaagguccuaggaac

SEQ ID NO: 10864 - RNA, 19 nt, Artificial Sequence
  source: /note="Description of Artificial Sequence: Synthetic oligonucleotide"
guuccuaggaccuuuauua

SEQ ID NO: 10865 - RNA, 19 nt, Artificial Sequence
  source: /note="Description of Artificial Sequence: Synthetic oligonucleotide"
aauuauacagaauucaaau

SEQ ID NO: 10866 - RNA, 19 nt, Artificial Sequence
  source: /note="Description of Artificial Sequence: Synthetic oligonucleotide"
auuugaauucuguauaauu

SEQ ID NO: 10867 - RNA, 19 nt, Artificial Sequence
  source: /note="Description of Artificial Sequence: Synthetic oligonucleotide"
cggagagcugcaagccagu

SEQ ID NO: 10868 - RNA, 19 nt, Artificial Sequence
  source: /note="Description of Artificial Sequence: Synthetic oligonucleotide"
acuggcuugcagcucuccg

SEQ ID NO: 10869 - RNA, 19 nt, Artificial Sequence
  source: /note="Description of Artificial Sequence: Synthetic oligonucleotide"
caagccagugcagcagccu

SEQ ID NO: 10870 - RNA, 19 nt, Artificial Sequence
  source: /note="Description of Artificial Sequence: Synthetic oligonucleotide"
aggcugcugcacuggcuug

SEQ ID NO: 10871 - RNA, 19 nt, Artificial Sequence
  source: /note="Description of Artificial Sequence: Synthetic oligonucleotide"
aagccagugcagcagccuu

SEQ ID NO: 10872 - RNA, 19 nt, Artificial Sequence
  source: /note="Description of Artificial Sequence: Synthetic oligonucleotide"
aaggcugcugcacuggcuu

SEQ ID NO: 10873 - RNA, 19 nt, Artificial Sequence
  source: /note="Description of Artificial Sequence: Synthetic oligonucleotide"
cagccuucagcuuuuggua

SEQ ID NO: 10874 - RNA, 19 nt, Artificial Sequence
  source: /note="Description of Artificial Sequence: Synthetic oligonucleotide"
uaccaaaagcugaaggcug

SEQ ID NO: 10875 - RNA, 19 nt, Artificial Sequence
  source: /note="Description of Artificial Sequence: Synthetic oligonucleotide"
ccuucagcuuuugguagca

SEQ ID NO: 10876 - RNA, 19 nt, Artificial Sequence
  source: /note="Description of Artificial Sequence: Synthetic oligonucleotide"
ugcuaccaaaagcugaagg

SEQ ID NO: 10877 - RNA, 19 nt, Artificial Sequence
  source: /note="Description of Artificial Sequence: Synthetic oligonucleotide"
cuuuugguagcaugaaagu

SEQ ID NO: 10878 - RNA, 19 nt, Artificial Sequence
  source: /note="Description of Artificial Sequence: Synthetic oligonucleotide"
acuuucaugcuaccaaaag

SEQ ID NO: 10879 - RNA, 19 nt, Artificial Sequence
  source: /note="Description of Artificial Sequence: Synthetic oligonucleotide"
uagcagagauaaagauggc

SEQ ID NO: 10880 - RNA, 19 nt, Artificial Sequence
  source: /note="Description of Artificial Sequence: Synthetic oligonucleotide"
gccaucuuuaucucugcua

SEQ ID NO: 10881 - RNA, 19 nt, Artificial Sequence
  source: /note="Description of Artificial Sequence: Synthetic oligonucleotide"
agauaaagauggcagcaag

SEQ ID NO: 10882 - RNA, 19 nt, Artificial Sequence
  source: /note="Description of Artificial Sequence: Synthetic oligonucleotide"
cuugcugccaucuuuaucu

SEQ ID NO: 10883 - RNA, 19 nt, Artificial Sequence
  source: /note="Description of Artificial Sequence: Synthetic oligonucleotide"
ccuggccaggguccugaca

SEQ ID NO: 10884 - RNA, 19 nt, Artificial Sequence
  source: /note="Description of Artificial Sequence: Synthetic oligonucleotide"
ugucaggacccuggccagg

SEQ ID NO: 10885 - RNA, 19 nt, Artificial Sequence
  source: /note="Description of Artificial Sequence: Synthetic oligonucleotide"
acaggccacaggaagucag

SEQ ID NO: 10886 - RNA, 19 nt, Artificial Sequence
  source: /note="Description of Artificial Sequence: Synthetic oligonucleotide"
cugacuuccuguggccugu

SEQ ID NO: 10887 - RNA, 19 nt, Artificial Sequence
  source: /note="Description of Artificial Sequence: Synthetic oligonucleotide"
caggccacaggaagucagu

SEQ ID NO: 10888 - RNA, 19 nt, Artificial Sequence
  source: /note="Description of Artificial Sequence: Synthetic oligonucleotide"
acugacuuccuguggccug

SEQ ID NO: 10889 - RNA, 19 nt, Artificial Sequence
  source: /note="Description of Artificial Sequence: Synthetic oligonucleotide"
acuuugugauucuggagaa

SEQ ID NO: 10890 - RNA, 19 nt, Artificial Sequence
  source: /note="Description of Artificial Sequence: Synthetic oligonucleotide"
uucuccagaaucacaaagu

SEQ ID NO: 10891 - RNA, 19 nt, Artificial Sequence
  source: /note="Description of Artificial Sequence: Synthetic oligonucleotide"
cuuugugauucuggagaac

SEQ ID NO: 10892 - RNA, 19 nt, Artificial Sequence
  source: /note="Description of Artificial Sequence: Synthetic oligonucleotide"
guucuccagaaucacaaag

SEQ ID NO: 10893 - RNA, 19 nt, Artificial Sequence
  source: /note="Description of Artificial Sequence: Synthetic oligonucleotide"
uugugauucuggagaacug

SEQ ID NO: 10894 - RNA, 19 nt, Artificial Sequence
  source: /note="Description of Artificial Sequence: Synthetic oligonucleotide"
caguucuccagaaucacaa

SEQ ID NO: 10895 - RNA, 19 nt, Artificial Sequence
  source: /note="Description of Artificial Sequence: Synthetic oligonucleotide"
ugugauucuggagaacugg

SEQ ID NO: 10896 - RNA, 19 nt, Artificial Sequence
  source: /note="Description of Artificial Sequence: Synthetic oligonucleotide"
ccaguucuccagaaucaca

SEQ ID NO: 10897 - RNA, 19 nt, Artificial Sequence
  source: /note="Description of Artificial Sequence: Synthetic oligonucleotide"
gugauucuggagaacuggu

SEQ ID NO: 10898 - RNA, 19 nt, Artificial Sequence
  source: /note="Description of Artificial Sequence: Synthetic oligonucleotide"
accaguucuccagaaucac

SEQ ID NO: 10899 - RNA, 19 nt, Artificial Sequence
  source: /note="Description of Artificial Sequence: Synthetic oligonucleotide"
ugauucuggagaacugguu

SEQ ID NO: 10900 - RNA, 19 nt, Artificial Sequence
  source: /note="Description of Artificial Sequence: Synthetic oligonucleotide"
aaccaguucuccagaauca

SEQ ID NO: 10901 - RNA, 19 nt, Artificial Sequence
  source: /note="Description of Artificial Sequence: Synthetic oligonucleotide"
cucugugacuuuggaagug

SEQ ID NO: 10902 - RNA, 19 nt, Artificial Sequence
  source: /note="Description of Artificial Sequence: Synthetic oligonucleotide"
cacuuccaaagucacagag

SEQ ID NO: 10903 - RNA, 19 nt, Artificial Sequence
  source: /note="Description of Artificial Sequence: Synthetic oligonucleotide"
ucugugacuuuggaagugc

SEQ ID NO: 10904 - RNA, 19 nt, Artificial Sequence
  source: /note="Description of Artificial Sequence: Synthetic oligonucleotide"
gcacuuccaaagucacaga

SEQ ID NO: 10905 - RNA, 19 nt, Artificial Sequence
  source: /note="Description of Artificial Sequence: Synthetic oligonucleotide"
uccgaggagagcccaaugu

SEQ ID NO: 10906 - RNA, 19 nt, Artificial Sequence
  source: /note="Description of Artificial Sequence: Synthetic oligonucleotide"
acauugggcucuccucgga

SEQ ID NO: 10907 - RNA, 19 nt, Artificial Sequence
  source: /note="Description of Artificial Sequence: Synthetic oligonucleotide"
aguugaucuuuggagccac

SEQ ID NO: 10908 - RNA, 19 nt, Artificial Sequence
  source: /note="Description of Artificial Sequence: Synthetic oligonucleotide"
guggcuccaaagaucaacu

SEQ ID NO: 10909 - RNA, 19 nt, Artificial Sequence
  source: /note="Description of Artificial Sequence: Synthetic oligonucleotide"
guugaucuuuggagccacu

SEQ ID NO: 10910 - RNA, 19 nt, Artificial Sequence
  source: /note="Description of Artificial Sequence: Synthetic oligonucleotide"
aguggcuccaaagaucaac

SEQ ID NO: 10911 - RNA, 19 nt, Artificial Sequence
  source: /note="Description of Artificial Sequence: Synthetic oligonucleotide"
uugaucuuuggagccacug

SEQ ID NO: 10912 - RNA, 19 nt, Artificial Sequence
  source: /note="Description of Artificial Sequence: Synthetic oligonucleotide"
caguggcuccaaagaucaa

SEQ ID NO: 10913 - RNA, 19 nt, Artificial Sequence
  source: /note="Description of Artificial Sequence: Synthetic oligonucleotide"
gaucuuuggagccacugau

SEQ ID NO: 10914 - RNA, 19 nt, Artificial Sequence
  source: /note="Description of Artificial Sequence: Synthetic oligonucleotide"
aucaguggcuccaaagauc

SEQ ID NO: 10915 - RNA, 19 nt, Artificial Sequence
  source: /note="Description of Artificial Sequence: Synthetic oligonucleotide"
auggucugcaggcugugug

SEQ ID NO: 10916 - RNA, 19 nt, Artificial Sequence
  source: /note="Description of Artificial Sequence: Synthetic oligonucleotide"
cacacagccugcagaccau

SEQ ID NO: 10917 - RNA, 19 nt, Artificial Sequence
  source: /note="Description of Artificial Sequence: Synthetic oligonucleotide"
gcaggcuguguguuggcug

SEQ ID NO: 10918 - RNA, 19 nt, Artificial Sequence
  source: /note="Description of Artificial Sequence: Synthetic oligonucleotide"
cagccaacacacagccugc

SEQ ID NO: 10919 - RNA, 19 nt, Artificial Sequence
  source: /note="Description of Artificial Sequence: Synthetic oligonucleotide"
ggcugaauuguugcuagga

SEQ ID NO: 10920 - RNA, 19 nt, Artificial Sequence
  source: /note="Description of Artificial Sequence: Synthetic oligonucleotide"
uccuagcaacaauucagcc

SEQ ID NO: 10921 - RNA, 19 nt, Artificial Sequence
  source: /note="Description of Artificial Sequence: Synthetic oligonucleotide"
uuuccuggggacaguggug

SEQ ID NO: 10922 - RNA, 19 nt, Artificial Sequence
  source: /note="Description of Artificial Sequence: Synthetic oligonucleotide"
caccacuguccccaggaaa

SEQ ID NO: 10923 - RNA, 19 nt, Artificial Sequence
  source: /note="Description of Artificial Sequence: Synthetic oligonucleotide"
uuccuggggacaguggugu

SEQ ID NO: 10924 - RNA, 19 nt, Artificial Sequence
  source: /note="Description of Artificial Sequence: Synthetic oligonucleotide"
acaccacuguccccaggaa

SEQ ID NO: 10925 - RNA, 19 nt, Artificial Sequence
  source: /note="Description of Artificial Sequence: Synthetic oligonucleotide"
accaacaagggagcaaauu

SEQ ID NO: 10926 - RNA, 19 nt, Artificial Sequence
  source: /note="Description of Artificial Sequence: Synthetic oligonucleotide"
aauuugcucccuuguuggu

SEQ ID NO: 10927 - RNA, 19 nt, Artificial Sequence
  source: /note="Description of Artificial Sequence: Synthetic oligonucleotide"
caaauuauacagaauucaa

SEQ ID NO: 10928 - RNA, 19 nt, Artificial Sequence
  source: /note="Description of Artificial Sequence: Synthetic oligonucleotide"
uugaauucuguauaauuug

SEQ ID NO: 10929 - RNA, 19 nt, Artificial Sequence
  source: /note="Description of Artificial Sequence: Synthetic oligonucleotide"
aaccaccuccuuugcggag

SEQ ID NO: 10930 - RNA, 19 nt, Artificial Sequence
  source: /note="Description of Artificial Sequence: Synthetic oligonucleotide"
cuccgcaaaggaggugguu

SEQ ID NO: 10931 - RNA, 19 nt, Artificial Sequence
  source: /note="Description of Artificial Sequence: Synthetic oligonucleotide"
accaccuccuuugcggaga

SEQ ID NO: 10932 - RNA, 19 nt, Artificial Sequence
  source: /note="Description of Artificial Sequence: Synthetic oligonucleotide"
ucuccgcaaaggagguggu

SEQ ID NO: 10933 - RNA, 19 nt, Artificial Sequence
  source: /note="Description of Artificial Sequence: Synthetic oligonucleotide"
ccaccuccuuugcggagag

SEQ ID NO: 10934 - RNA, 19 nt, Artificial Sequence
  source: /note="Description of Artificial Sequence: Synthetic oligonucleotide"
cucuccgcaaaggaggugg

SEQ ID NO: 10935 - RNA, 19 nt, Artificial Sequence
  source: /note="Description of Artificial Sequence: Synthetic oligonucleotide"
ggaaauggaucauuuggug

SEQ ID NO: 10936 - RNA, 19 nt, Artificial Sequence
  source: /note="Description of Artificial Sequence: Synthetic oligonucleotide"
caccaaaugauccauuucc

SEQ ID NO: 10937 - RNA, 19 nt, Artificial Sequence
  source: /note="Description of Artificial Sequence: Synthetic oligonucleotide"
gaguggugagaagaaagau

SEQ ID NO: 10938 - RNA, 19 nt, Artificial Sequence
  source: /note="Description of Artificial Sequence: Synthetic oligonucleotide"
aucuuucuucucaccacuc

SEQ ID NO: 10939 - RNA, 19 nt, Artificial Sequence
  source: /note="Description of Artificial Sequence: Synthetic oligonucleotide"
caucgagacauuaaaccac

SEQ ID NO: 10940 - RNA, 19 nt, Artificial Sequence
  source: /note="Description of Artificial Sequence: Synthetic oligonucleotide"
gugguuuaaugucucgaug

SEQ ID NO: 10941 - RNA, 19 nt, Artificial Sequence
  source: /note="Description of Artificial Sequence: Synthetic oligonucleotide"
ucgagacauuaaaccacag

SEQ ID NO: 10942 - RNA, 19 nt, Artificial Sequence
  source: /note="Description of Artificial Sequence: Synthetic oligonucleotide"
cugugguuuaaugucucga

SEQ ID NO: 10943 - RNA, 19 nt, Artificial Sequence
  source: /note="Description of Artificial Sequence: Synthetic oligonucleotide"
aucgagacauuaaaccaca

SEQ ID NO: 10944 - RNA, 19 nt, Artificial Sequence
  source: /note="Description of Artificial Sequence: Synthetic oligonucleotide"
ugugguuuaaugucucgau

SEQ ID NO: 10945 - RNA, 19 nt, Artificial Sequence
  source: /note="Description of Artificial Sequence: Synthetic oligonucleotide"
gccaucgagacauuaaacc

SEQ ID NO: 10946 - RNA, 19 nt, Artificial Sequence
  source: /note="Description of Artificial Sequence: Synthetic oligonucleotide"
gguuuaaugucucgauggc

SEQ ID NO: 10947 - RNA, 19 nt, Artificial Sequence
  source: /note="Description of Artificial Sequence: Synthetic oligonucleotide"
ccaucgagacauuaaacca

SEQ ID NO: 10948 - RNA, 19 nt, Artificial Sequence
  source: /note="Description of Artificial Sequence: Synthetic oligonucleotide"
ugguuuaaugucucgaugg

SEQ ID NO: 10949 - RNA, 19 nt, Artificial Sequence
  source: /note="Description of Artificial Sequence: Synthetic oligonucleotide"
cacaguaguggcaacuccu

SEQ ID NO: 10950 - RNA, 19 nt, Artificial Sequence
  source: /note="Description of Artificial Sequence: Synthetic oligonucleotide"
aggaguugccacuacugug

SEQ ID NO: 10951 - RNA, 19 nt, Artificial Sequence
  source: /note="Description of Artificial Sequence: Synthetic oligonucleotide"
gagacauuaaaccacagaa

SEQ ID NO: 10952 - RNA, 19 nt, Artificial Sequence
  source: /note="Description of Artificial Sequence: Synthetic oligonucleotide"
uucugugguuuaaugucuc

SEQ ID NO: 10953 - RNA, 19 nt, Artificial Sequence
  source: /note="Description of Artificial Sequence: Synthetic oligonucleotide"
caguaguggcaacuccugg

SEQ ID NO: 10954 - RNA, 19 nt, Artificial Sequence
  source: /note="Description of Artificial Sequence: Synthetic oligonucleotide"
ccaggaguugccacuacug

SEQ ID NO: 10955 - RNA, 19 nt, Artificial Sequence
  source: /note="Description of Artificial Sequence: Synthetic oligonucleotide"
gagagcuccagaucaugag

SEQ ID NO: 10956 - RNA, 19 nt, Artificial Sequence
  source: /note="Description of Artificial Sequence: Synthetic oligonucleotide"
cucaugaucuggagcucuc

SEQ ID NO: 10957 - RNA, 19 nt, Artificial Sequence
  source: /note="Description of Artificial Sequence: Synthetic oligonucleotide"
cgagacauuaaaccacaga

SEQ ID NO: 10958 - RNA, 19 nt, Artificial Sequence
  source: /note="Description of Artificial Sequence: Synthetic oligonucleotide"
ucugugguuuaaugucucg

SEQ ID NO: 10959 - RNA, 19 nt, Artificial Sequence
  source: /note="Description of Artificial Sequence: Synthetic oligonucleotide"
agacauuaaaccacagaac

SEQ ID NO: 10960 - RNA, 19 nt, Artificial Sequence
  source: /note="Description of Artificial Sequence: Synthetic oligonucleotide"
guucugugguuuaaugucu

SEQ ID NO: 10961 - RNA, 19 nt, Artificial Sequence
  source: /note="Description of Artificial Sequence: Synthetic oligonucleotide"
uaaaacucugugacuuugg

SEQ ID NO: 10962 - RNA, 19 nt, Artificial Sequence
  source: /note="Description of Artificial Sequence: Synthetic oligonucleotide"
ccaaagucacagaguuuua

SEQ ID NO: 10963 - RNA, 19 nt, Artificial Sequence
  source: /note="Description of Artificial Sequence: Synthetic oligonucleotide"
cugugacuuuggaagugca

SEQ ID NO: 10964 - RNA, 19 nt, Artificial Sequence
  source: /note="Description of Artificial Sequence: Synthetic oligonucleotide"
ugcacuuccaaagucacag

SEQ ID NO: 10965 - RNA, 19 nt, Artificial Sequence
  source: /note="Description of Artificial Sequence: Synthetic oligonucleotide"
gacuuuggaagugcaaagc

SEQ ID NO: 10966 - RNA, 19 nt, Artificial Sequence
  source: /note="Description of Artificial Sequence: Synthetic oligonucleotide"
gcuuugcacuuccaaaguc

SEQ ID NO: 10967 - RNA, 19 nt, Artificial Sequence
  source: /note="Description of Artificial Sequence: Synthetic oligonucleotide"
aagugcaaagcagcugguc

SEQ ID NO: 10968 - RNA, 19 nt, Artificial Sequence
  source: /note="Description of Artificial Sequence: Synthetic oligonucleotide"
gaccagcugcuuugcacuu

SEQ ID NO: 10969 - RNA, 19 nt, Artificial Sequence
  source: /note="Description of Artificial Sequence: Synthetic oligonucleotide"
aauggaucauuuggugugg

SEQ ID NO: 10970 - RNA, 19 nt, Artificial Sequence
  source: /note="Description of Artificial Sequence: Synthetic oligonucleotide"
ccacaccaaaugauccauu

SEQ ID NO: 10971 - RNA, 19 nt, Artificial Sequence
  source: /note="Description of Artificial Sequence: Synthetic oligonucleotide"
ucugcuggaguacacaccu

SEQ ID NO: 10972 - RNA, 19 nt, Artificial Sequence
  source: /note="Description of Artificial Sequence: Synthetic oligonucleotide"
agguguguacuccagcaga

SEQ ID NO: 10973 - RNA, 19 nt, Artificial Sequence
  source: /note="Description of Artificial Sequence: Synthetic oligonucleotide"
aaauggaucauuuggugug

SEQ ID NO: 10974 - RNA, 19 nt, Artificial Sequence
  source: /note="Description of Artificial Sequence: Synthetic oligonucleotide"
cacaccaaaugauccauuu

SEQ ID NO: 10975 - RNA, 19 nt, Artificial Sequence
  source: /note="Description of Artificial Sequence: Synthetic oligonucleotide"
gugagaagaaagaugaggu

SEQ ID NO: 10976 - RNA, 19 nt, Artificial Sequence
  source: /note="Description of Artificial Sequence: Synthetic oligonucleotide"
accucaucuuucuucucac

SEQ ID NO: 10977 - RNA, 19 nt, Artificial Sequence
  source: /note="Description of Artificial Sequence: Synthetic oligonucleotide"
auccauuccuuuggaaucu

SEQ ID NO: 10978 - RNA, 19 nt, Artificial Sequence
  source: /note="Description of Artificial Sequence: Synthetic oligonucleotide"
agauuccaaaggaauggau

SEQ ID NO: 10979 - RNA, 19 nt, Artificial Sequence
  source: /note="Description of Artificial Sequence: Synthetic oligonucleotide"
aaaacucugugacuuugga

SEQ ID NO: 10980 - RNA, 19 nt, Artificial Sequence
  source: /note="Description of Artificial Sequence: Synthetic oligonucleotide"
uccaaagucacagaguuuu

SEQ ID NO: 10981 - RNA, 19 nt, Artificial Sequence
  source: /note="Description of Artificial Sequence: Synthetic oligonucleotide"
uggucugcaggcugugugu

SEQ ID NO: 10982 - RNA, 19 nt, Artificial Sequence
  source: /note="Description of Artificial Sequence: Synthetic oligonucleotide"
acacacagccugcagacca

SEQ ID NO: 10983 - RNA, 19 nt, Artificial Sequence
  source: /note="Description of Artificial Sequence: Synthetic oligonucleotide"
gaaauggaucauuuggugu

SEQ ID NO: 10984 - RNA, 19 nt, Artificial Sequence
  source: /note="Description of Artificial Sequence: Synthetic oligonucleotide"
acaccaaaugauccauuuc

SEQ ID NO: 10985 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguaacauaguccgacutt

SEQ ID NO: 10986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucggacuauguuacagutt

SEQ ID NO: 10987 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaacauaguccgacugtt

SEQ ID NO: 10988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagucggacuauguuacagtt

SEQ ID NO: 10989 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagacacuauagucgagtt

SEQ ID NO: 10990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgacuauagugucuggctt

SEQ ID NO: 10991 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacauaguccgacugcggutt

SEQ ID NO: 10992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcagucggacuauguutt

SEQ ID NO: 10993 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccacuguaacauagucctt

SEQ ID NO: 10994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacuauguuacagugguctt

SEQ ID NO: 10995 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacauaguccgacugcggtt

SEQ ID NO: 10996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcagucggacuauguuatt

SEQ ID NO: 10997 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauaguccgacugcgguautt

SEQ ID NO: 10998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaccgcagucggacuaugtt

SEQ ID NO: 10999 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacacuauagucgagccatt

SEQ ID NO: 11000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcucgacuauagugucutt

SEQ ID NO: 11001 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacuauagucgagccaagtt

SEQ ID NO: 11002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggcucgacuauagugutt

SEQ ID NO: 11003 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauauaucuguucucgguatt

SEQ ID NO: 11004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgagaacagauauaugtt

SEQ ID NO: 11005 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaggacaagcgauuuaatt

SEQ ID NO: 11006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaucgcuuguccuguatt

SEQ ID NO: 11007 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguauuucuucuacucgatt

SEQ ID NO: 11008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaguagaagaaauaccgtt

SEQ ID NO: 11009 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucagaagucuagccuauatt

SEQ ID NO: 11010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaggcuagacuucugaatt

SEQ ID NO: 11011 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguauuucuucuacucgagtt

SEQ ID NO: 11012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgaguagaagaaauacctt

SEQ ID NO: 11013 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuaccgcccggcuaactt

SEQ ID NO: 11014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuagccgggcgguaggugtt

SEQ ID NO: 11015 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcgauuuaagaaccgagtt

SEQ ID NO: 11016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgguucuuaaaucgcuutt

SEQ ID NO: 11017 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaacauaguccgacugctt

SEQ ID NO: 11018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagucggacuauguuacatt

SEQ ID NO: 11019 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauuacacguccaguauatt

SEQ ID NO: 11020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacuggacguguaaucatt

SEQ ID NO: 11021 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acguccaguauagauguautt

SEQ ID NO: 11022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacaucuauacuggacgutt

SEQ ID NO: 11023 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacgaaagugauuggaatt

SEQ ID NO: 11024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaaucacuuucguguctt

SEQ ID NO: 11025 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaacauaguccgacugcgtt

SEQ ID NO: 11026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcagucggacuauguuactt

SEQ ID NO: 11027 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguccgacugcgguauuutt

SEQ ID NO: 11028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauaccgcagucggacuatt

SEQ ID NO: 11029 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuacucgaguggugagatt

SEQ ID NO: 11030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucaccacucgaguagaatt

SEQ ID NO: 11031 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagaagucuagccuauautt

SEQ ID NO: 11032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauaggcuagacuucugatt

SEQ ID NO: 11033 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagucuagccuauaucctt

SEQ ID NO: 11034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauauaggcuagacuucutt

SEQ ID NO: 11035 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugauuacacguccaguautt

SEQ ID NO: 11036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacuggacguguaaucagtt

SEQ ID NO: 11037 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaggacaagcgauuuaagtt

SEQ ID NO: 11038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuaaaucgcuuguccugutt

SEQ ID NO: 11039 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuauguuccggagacagtt

SEQ ID NO: 11040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugucuccggaacauaguctt

SEQ ID NO: 11041 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucagaagucuagccuautt

SEQ ID NO: 11042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaggcuagacuucugaactt

SEQ ID NO: 11043 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacaccuaccgcccggctt

SEQ ID NO: 11044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgggcgguagguguguatt

SEQ ID NO: 11045 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaggaagucaguuauacatt

SEQ ID NO: 11046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauaacugacuuccugutt

SEQ ID NO: 11047 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuguaacauaguccgatt

SEQ ID NO: 11048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggacuauguuacaguggtt

SEQ ID NO: 11049 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaguacacaccuaccgctt

SEQ ID NO: 11050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgguagguguguacuccatt

SEQ ID NO: 11051 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauguuccggagacagugtt

SEQ ID NO: 11052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugucuccggaacauagtt

SEQ ID NO: 11053 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguucucgguacuacaggtt

SEQ ID NO: 11054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuguaguaccgagaacagtt

SEQ ID NO: 11055 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucucgguacuacagggtt

SEQ ID NO: 11056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuguaguaccgagaacatt

SEQ ID NO: 11057 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcccggcuaacaccacutt

SEQ ID NO: 11058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugguguuagccgggcggtt

SEQ ID NO: 11059 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccgcccggcuaacacctt

SEQ ID NO: 11060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguuagccgggcgguagtt

SEQ ID NO: 11061 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuacacguccaguauagatt

SEQ ID NO: 11062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuauacuggacguguaautt

SEQ ID NO: 11063 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacucgaguggugagaagtt

SEQ ID NO: 11064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucucaccacucgaguagtt

SEQ ID NO: 11065 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggacuauguuccggagtt

SEQ ID NO: 11066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccggaacauaguccagctt

SEQ ID NO: 11067 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggacuauguuccggagatt

SEQ ID NO: 11068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccggaacauaguccagtt

SEQ ID NO: 11069 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgccagacacuauagucgtt

SEQ ID NO: 11070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacuauagugucuggcgatt

SEQ ID NO: 11071 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuauagucgagccaagctt

SEQ ID NO: 11072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuggcucgacuauagugtt

SEQ ID NO: 11073 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuacacguccaguauagtt

SEQ ID NO: 11074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauacuggacguguaauctt

SEQ ID NO: 11075 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacacguccaguauagautt

SEQ ID NO: 11076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuauacuggacguguaatt

SEQ ID NO: 11077 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggccccgaacuccaccatt

SEQ ID NO: 11078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguggaguucggggccggtt

SEQ ID NO: 11079 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacaccuaccgcccggcutt

SEQ ID NO: 11080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccgggcgguaggugugutt

SEQ ID NO: 11081 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaccuaccgcccggcuatt

SEQ ID NO: 11082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccgggcgguaggugugtt

SEQ ID NO: 11083 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuaccgcccggcuaacatt

SEQ ID NO: 11084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuagccgggcgguaggutt

SEQ ID NO: 11085 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaccgcccggcuaacactt

SEQ ID NO: 11086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguuagccgggcgguaggtt

SEQ ID NO: 11087 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugucggggcgaccgagatt

SEQ ID NO: 11088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucggucgccccgacaugtt

SEQ ID NO: 11089 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucggggcgaccgagaacctt

SEQ ID NO: 11090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucucggucgccccgactt

SEQ ID NO: 11091 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgaccgagaaccaccuctt

SEQ ID NO: 11092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggugguucucggucgcctt

SEQ ID NO: 11093 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaagcgauuuaagaacctt

SEQ ID NO: 11094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucuuaaaucgcuuguctt

SEQ ID NO: 11095 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcgauuuaagaaccgagatt

SEQ ID NO: 11096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgguucuuaaaucgcutt

SEQ ID NO: 11097 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgauuuaagaaccgagagtt

SEQ ID NO: 11098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucucgguucuuaaaucgctt

SEQ ID NO: 11099 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgauuuaagaaccgagagctt

SEQ ID NO: 11100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucucgguucuuaaaucgtt

SEQ ID NO: 11101 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuagaccacuguaacatt

SEQ ID NO: 11102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuacaguggucuagcuutt

SEQ ID NO: 11103 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaccacuguaacauagutt

SEQ ID NO: 11104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuauguuacaguggucuatt

SEQ ID NO: 11105 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaguccgacugcgguauutt

SEQ ID NO: 11106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauaccgcagucggacuautt

SEQ ID NO: 11107 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguccgacugcgguauuuctt

SEQ ID NO: 11108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaauaccgcagucggacutt

SEQ ID NO: 11109 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccgacugcgguauuucutt

SEQ ID NO: 11110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaauaccgcagucggactt

SEQ ID NO: 11111 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgacugcgguauuucuuctt

SEQ ID NO: 11112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaaauaccgcagucggtt

SEQ ID NO: 11113 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucuacucgaguggugagtt

SEQ ID NO: 11114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaccacucgaguagaagtt

SEQ ID NO: 11115 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugaggucuaccuuaacctt

SEQ ID NO: 11116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuaagguagaccucauctt

SEQ ID NO: 11117 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcuggacuauguuccggtt

SEQ ID NO: 11118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggaacauaguccagcactt

SEQ ID NO: 11119 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuccggagacaguguactt

SEQ ID NO: 11120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacacugucuccggaacatt

SEQ ID NO: 11121 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagacacuauagucgagctt

SEQ ID NO: 11122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucgacuauagugucuggtt

SEQ ID NO: 11123 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuauagucgagccaagcatt

SEQ ID NO: 11124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuuggcucgacuauagutt

SEQ ID NO: 11125 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauagucgagccaagcagtt

SEQ ID NO: 11126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuuggcucgacuauagtt

SEQ ID NO: 11127 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaagucuagccuauauctt

SEQ ID NO: 11128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauauaggcuagacuucugtt

SEQ ID NO: 11129 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuggauccugauacagcutt

SEQ ID NO: 11130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuguaucaggauccaactt

SEQ ID NO: 11131 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucgguacuacagggcatt

SEQ ID NO: 11132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcccuguaguaccgagaatt

SEQ ID NO: 11133 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacagggcaccagaguugtt

SEQ ID NO: 11134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacucuggugcccuguagtt

SEQ ID NO: 11135 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugauuacacguccagutt

SEQ ID NO: 11136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggacguguaaucagugtt

SEQ ID NO: 11137 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugauuacacguccaguatt

SEQ ID NO: 11138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuggacguguaaucagutt

SEQ ID NO: 11139 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacguccaguauagaugutt

SEQ ID NO: 11140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaucuauacuggacgugutt

SEQ ID NO: 11141 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacguccaguauagauguatt

SEQ ID NO: 11142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaucuauacuggacgugtt

SEQ ID NO: 11143 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcuaggacaaccaauautt

SEQ ID NO: 11144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauugguuguccuagcaatt

SEQ ID NO: 11145 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuaggacaaccaauauutt

SEQ ID NO: 11146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauauugguuguccuagcatt

SEQ ID NO: 11147 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggacaaccaauauuuctt

SEQ ID NO: 11148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaauauugguuguccuagtt

SEQ ID NO: 11149 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugguguggaucaguuggtt

SEQ ID NO: 11150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaacugauccacaccacutt

SEQ ID NO: 11151 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguacacaccuaccgcctt

SEQ ID NO: 11152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgguagguguguacucctt

SEQ ID NO: 11153 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacacaccuaccgcccggtt

SEQ ID NO: 11154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgggcgguagguguguactt

SEQ ID NO: 11155 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcccggcuaacaccactt

SEQ ID NO: 11156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguguuagccgggcggutt

SEQ ID NO: 11157 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggcuaacaccacuggaatt

SEQ ID NO: 11158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccagugguguuagccggtt

SEQ ID NO: 11159 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagacacgaaagugauuggtt

SEQ ID NO: 11160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaucacuuucgugucugtt

SEQ ID NO: 11161 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucauuuggugugguauautt

SEQ ID NO: 11162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauaccacaccaaaugautt

SEQ ID NO: 11163 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuuggugugguauaucatt

SEQ ID NO: 11164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauauaccacaccaaaugtt

SEQ ID NO: 11165 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuagaccacuguaacautt

SEQ ID NO: 11166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguuacaguggucuagcutt

SEQ ID NO: 11167 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauaguccgacugcgguatt

SEQ ID NO: 11168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgcagucggacuaugutt

SEQ ID NO: 11169 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacucgaguggugagaatt

SEQ ID NO: 11170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucaccacucgaguagatt

SEQ ID NO: 11171 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaguuguauauguaucatt

SEQ ID NO: 11172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauacauauacaacuugatt

SEQ ID NO: 11173 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaucagcuguucagaagutt

SEQ ID NO: 11174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuucugaacagcugauactt

SEQ ID NO: 11175 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucugccaucgagacauuatt

SEQ ID NO: 11176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaugucucgauggcagautt

SEQ ID NO: 11177 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagagcccaauguuucautt

SEQ ID NO: 11178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaaacauugggcucucctt

SEQ ID NO: 11179 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauauaucuguucucggutt

SEQ ID NO: 11180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgagaacagauauaugatt

SEQ ID NO: 11181 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgguacuacagggcacctt

SEQ ID NO: 11182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugcccuguaguaccgagtt

SEQ ID NO: 11183 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugguguggaucaguugtt

SEQ ID NO: 11184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacugauccacaccacugtt

SEQ ID NO: 11185 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagggagcaaauuagagtt

SEQ ID NO: 11186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuaauuugcucccuugutt

SEQ ID NO: 11187 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaaaggucuuccggcctt

SEQ ID NO: 11188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccggaagaccuuugucctt

SEQ ID NO: 11189 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggggcgaccgagaaccatt

SEQ ID NO: 11190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguucucggucgccccgatt

SEQ ID NO: 11191 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcgaccgagaaccaccutt

SEQ ID NO: 11192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggugguucucggucgccctt

SEQ ID NO: 11193 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccaccuccuuugcggtt

SEQ ID NO: 11194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcaaaggaggugguucutt

SEQ ID NO: 11195 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuugguagcaugaaaguutt

SEQ ID NO: 11196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuuucaugcuaccaaaatt

SEQ ID NO: 11197 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaggaagucaguuauactt

SEQ ID NO: 11198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauaacugacuuccugugtt

SEQ ID NO: 11199 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaagucaguuauacagtt

SEQ ID NO: 11200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguauaacugacuuccugtt

SEQ ID NO: 11201 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaagucaguuauacagatt

SEQ ID NO: 11202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguauaacugacuuccutt

SEQ ID NO: 11203 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagucaguuauacagactt

SEQ ID NO: 11204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuguauaacugacuucctt

SEQ ID NO: 11205 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugauuggaaauggaucatt

SEQ ID NO: 11206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauccauuuccaaucacutt

SEQ ID NO: 11207 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugauuggaaauggaucautt

SEQ ID NO: 11208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augauccauuuccaaucactt

SEQ ID NO: 11209 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuggaaauggaucauuutt

SEQ ID NO: 11210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaugauccauuuccaauctt

SEQ ID NO: 11211 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggugugguauaucaagtt

SEQ ID NO: 11212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugauauaccacaccaaatt

SEQ ID NO: 11213 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggugugguauaucaagctt

SEQ ID NO: 11214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugauauaccacaccaatt

SEQ ID NO: 11215 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugugguauaucaagccatt

SEQ ID NO: 11216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuugauauaccacacctt

SEQ ID NO: 11217 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagccaaacuuugugauutt

SEQ ID NO: 11218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucacaaaguuuggcuugtt

SEQ ID NO: 11219 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuacaggacaagcgauutt

SEQ ID NO: 11220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucgcuuguccuguagaatt

SEQ ID NO: 11221 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaaagcuagaccacugutt

SEQ ID NO: 11222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguggucuagcuuucuctt

SEQ ID NO: 11223 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaagcuagaccacuguatt

SEQ ID NO: 11224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaguggucuagcuuucutt

SEQ ID NO: 11225 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaccacuguaacauaguctt

SEQ ID NO: 11226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuauguuacaguggucutt

SEQ ID NO: 11227 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuguaacauaguccgtt

SEQ ID NO: 11228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggacuauguuacaguggutt

SEQ ID NO: 11229 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuguaacauaguccgactt

SEQ ID NO: 11230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucggacuauguuacagugtt

SEQ ID NO: 11231 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauuucuucuacucgagutt

SEQ ID NO: 11232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucgaguagaagaaauactt

SEQ ID NO: 11233 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuucuucuacucgagugtt

SEQ ID NO: 11234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucgaguagaagaaauatt

SEQ ID NO: 11235 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuucuacucgaguggutt

SEQ ID NO: 11236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacucgaguagaagaaatt

SEQ ID NO: 11237 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacucgaguggugagaagatt

SEQ ID NO: 11238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucucaccacucgaguatt

SEQ ID NO: 11239 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaugaggucuaccuuaactt

SEQ ID NO: 11240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaagguagaccucaucutt

SEQ ID NO: 11241 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacuauguuccggagacatt

SEQ ID NO: 11242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucuccggaacauagucctt

SEQ ID NO: 11243 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagacacuauagucgagcctt

SEQ ID NO: 11244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucgacuauagugucugtt

SEQ ID NO: 11245 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauauguaucagcuguucatt

SEQ ID NO: 11246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacagcugauacauauatt

SEQ ID NO: 11247 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguucagaagucuagcctt

SEQ ID NO: 11248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuagacuucugaacagctt

SEQ ID NO: 11249 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguucagaagucuagccuatt

SEQ ID NO: 11250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggcuagacuucugaacatt

SEQ ID NO: 11251 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagucuagccuauauccautt

SEQ ID NO: 11252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggauauaggcuagacuutt

SEQ ID NO: 11253 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaucugccaucgagacautt

SEQ ID NO: 11254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augucucgauggcagauuctt

SEQ ID NO: 11255 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaccacagaaccucuugutt

SEQ ID NO: 11256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagagguucugugguuutt

SEQ ID NO: 11257 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucuuguuggauccugatt

SEQ ID NO: 11258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaggauccaacaagaggutt

SEQ ID NO: 11259 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuggauccugauacagctt

SEQ ID NO: 11260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguaucaggauccaacatt

SEQ ID NO: 11261 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugauacagcuguauuaatt

SEQ ID NO: 11262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaauacagcuguaucaggtt

SEQ ID NO: 11263 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucauauaucuguucucggtt

SEQ ID NO: 11264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagaacagauauaugaatt

SEQ ID NO: 11265 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggcaccagaguugaucutt

SEQ ID NO: 11266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaucaacucuggugcccutt

SEQ ID NO: 11267 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagccacugauuacacgutt

SEQ ID NO: 11268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acguguaaucaguggcucctt

SEQ ID NO: 11269 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccacugauuacacguctt

SEQ ID NO: 11270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacguguaaucaguggcuctt

SEQ ID NO: 11271 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacguccaguauagaugtt

SEQ ID NO: 11272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuauacuggacguguatt

SEQ ID NO: 11273 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguccaguauagauguaugtt

SEQ ID NO: 11274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauacaucuauacuggacgtt

SEQ ID NO: 11275 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaguauagauguauggtt

SEQ ID NO: 11276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauacaucuauacuggactt

SEQ ID NO: 11277 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguauagauguauggucutt

SEQ ID NO: 11278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaccauacaucuauacugtt

SEQ ID NO: 11279 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauagauguauggucugcatt

SEQ ID NO: 11280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagaccauacaucuauatt

SEQ ID NO: 11281 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauguauggucugcaggctt

SEQ ID NO: 11282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugcagaccauacaucutt

SEQ ID NO: 11283 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaauuguugcuaggacatt

SEQ ID NO: 11284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccuagcaacaauucagtt

SEQ ID NO: 11285 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaggacaaccaauauuutt

SEQ ID NO: 11286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauauugguuguccuagctt

SEQ ID NO: 11287 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccaauauuuccuggggatt

SEQ ID NO: 11288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccccaggaaauauugguutt

SEQ ID NO: 11289 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuaggaacaccaacaatt

SEQ ID NO: 11290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguugguguuccuaggactt

SEQ ID NO: 11291 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuaggaacaccaacaagtt

SEQ ID NO: 11292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguugguguuccuaggatt

SEQ ID NO: 11293 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggaacaccaacaagggtt

SEQ ID NO: 11294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuuguugguguuccuagtt

SEQ ID NO: 11295 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaacaccaacaagggagtt

SEQ ID NO: 11296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccuuguugguguuccutt

SEQ ID NO: 11297 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagggagcaaauuagagatt

SEQ ID NO: 11298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucuaauuugcucccuugtt

SEQ ID NO: 11299 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaauucccucaaaucaatt

SEQ ID NO: 11300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugauuugagggaauuugatt

SEQ ID NO: 11301 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucuuccggccccgaacutt

SEQ ID NO: 11302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucggggccggaagacctt

SEQ ID NO: 11303 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuuccggccccgaacuctt

SEQ ID NO: 11304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguucggggccggaagactt

SEQ ID NO: 11305 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccggccccgaacuccatt

SEQ ID NO: 11306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaguucggggccggaagtt

SEQ ID NO: 11307 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccagaggcaauugcactt

SEQ ID NO: 11308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcaauugccucugguggtt

SEQ ID NO: 11309 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacugugcagccgucugtt

SEQ ID NO: 11310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagacggcugcacagugcatt

SEQ ID NO: 11311 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaguacacaccuaccgtt

SEQ ID NO: 11312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguagguguguacuccagtt

SEQ ID NO: 11313 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguacacaccuaccgcccgtt

SEQ ID NO: 11314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgggcgguagguguguacutt

SEQ ID NO: 11315 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccggcuaacaccacuggatt

SEQ ID NO: 11316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagugguguuagccgggtt

SEQ ID NO: 11317 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuaacaccacuggaagctt

SEQ ID NO: 11318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuccagugguguuagcctt

SEQ ID NO: 11319 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguguacagagucgccagtt

SEQ ID NO: 11320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcgacucuguacacugtt

SEQ ID NO: 11321 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugugaucuaugucaagutt

SEQ ID NO: 11322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuugacauagaucacaggtt

SEQ ID NO: 11323 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuucauauaucuguucutt

SEQ ID NO: 11324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaacagauauaugaaacatt

SEQ ID NO: 11325 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuggcugaauuguugcuatt

SEQ ID NO: 11326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcaacaauucagccaactt

SEQ ID NO: 11327 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuagagaaaugaacccaaatt

SEQ ID NO: 11328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggguucauuucucuaatt

SEQ ID NO: 11329 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucaaauucccucaaauctt

SEQ ID NO: 11330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuugagggaauuugaautt

SEQ ID NO: 11331 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcagcaagguaaccacatt

SEQ ID NO: 11332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugguuaccuugcugccatt

SEQ ID NO: 11333 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguuauacagacacgaatt

SEQ ID NO: 11334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucgugucuguauaacugatt

SEQ ID NO: 11335 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacucccugugaucuaugtt

SEQ ID NO: 11336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauagaucacagggagugutt

SEQ ID NO: 11337 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccucuuguuggauccutt

SEQ ID NO: 11338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggauccaacaagagguuctt

SEQ ID NO: 11339 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggauccugauacagcugutt

SEQ ID NO: 11340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcuguaucaggauccatt

SEQ ID NO: 11341 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauguuucauauaucuguutt

SEQ ID NO: 11342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacagauauaugaaacauutt

SEQ ID NO: 11343 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguucucgguacuacagtt

SEQ ID NO: 11344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaguaccgagaacagatt

SEQ ID NO: 11345 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugaauuguugcuaggactt

SEQ ID NO: 11346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuagcaacaauucagctt

SEQ ID NO: 11347 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguggaucaguugguggtt

SEQ ID NO: 11348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccaacugauccacacctt

SEQ ID NO: 11349 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccaccagaggcaauugctt

SEQ ID NO: 11350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaauugccucugguggagtt

SEQ ID NO: 11351 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccuccuuugcggagagctt

SEQ ID NO: 11352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuccgcaaaggaggugtt

SEQ ID NO: 11353 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaguguacagagucgcctt

SEQ ID NO: 11354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgacucuguacacuguctt

SEQ ID NO: 11355 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugguagcaugaaaguuatt

SEQ ID NO: 11356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacuuucaugcuaccaaatt

SEQ ID NO: 11357 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagauggcagcaagguaactt

SEQ ID NO: 11358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuaccuugcugccaucuutt

SEQ ID NO: 11359 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacaggaagucaguuautt

SEQ ID NO: 11360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaacugacuuccuguggctt

SEQ ID NO: 11361 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuggugugguauaucaatt

SEQ ID NO: 11362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugauauaccacaccaaautt

SEQ ID NO: 11363 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagccaaacuuugugautt

SEQ ID NO: 11364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucacaaaguuuggcuugatt

SEQ ID NO: 11365 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggagaacugguugccautt

SEQ ID NO: 11366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcaaccaguucuccagtt

SEQ ID NO: 11367 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucuagccuauauccauutt

SEQ ID NO: 11368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggauauaggcuagacutt

SEQ ID NO: 11369 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucuuguuggauccugautt

SEQ ID NO: 11370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaggauccaacaagaggtt

SEQ ID NO: 11371 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugauacagcuguauuaaatt

SEQ ID NO: 11372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaauacagcuguaucagtt

SEQ ID NO: 11373 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuguauuaaaacucugutt

SEQ ID NO: 11374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagaguuuuaauacagcutt

SEQ ID NO: 11375 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuuggagccacugauuatt

SEQ ID NO: 11376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaucaguggcuccaaagatt

SEQ ID NO: 11377 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggagccacugauuacatt

SEQ ID NO: 11378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaaucaguggcuccaaatt

SEQ ID NO: 11379 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagugguguggaucaguutt

SEQ ID NO: 11380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugauccacaccacugutt

SEQ ID NO: 11381 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauaauaaagguccuaggtt

SEQ ID NO: 11382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaggaccuuuauuauuutt

SEQ ID NO: 11383 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagaauucaaauucccuctt

SEQ ID NO: 11384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagggaauuugaauucugutt

SEQ ID NO: 11385 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguucagaagucuagccutt

SEQ ID NO: 11386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuagacuucugaacagtt

SEQ ID NO: 11387 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccuaggaacaccaacatt

SEQ ID NO: 11388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguugguguuccuaggacctt

SEQ ID NO: 11389 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaacaagggagcaaauuatt

SEQ ID NO: 11390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauuugcucccuuguuggtt

SEQ ID NO: 11391 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggucuuccggccccgaactt

SEQ ID NO: 11392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucggggccggaagaccutt

SEQ ID NO: 11393 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgguacuacagggcactt

SEQ ID NO: 11394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcccuguaguaccgagatt

SEQ ID NO: 11395 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguggcaacuccuggccatt

SEQ ID NO: 11396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccaggaguugccacuatt

SEQ ID NO: 11397 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagaaagcuagaccacugtt

SEQ ID NO: 11398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguggucuagcuuucucatt

SEQ ID NO: 11399 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauacagcuguauuaaaatt

SEQ ID NO: 11400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuuaauacagcuguaucatt

SEQ ID NO: 11401 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcuguguguuggcugaatt

SEQ ID NO: 11402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucagccaacacacagccutt

SEQ ID NO: 11403 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccacaggaagucaguuatt

SEQ ID NO: 11404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacugacuuccuguggcctt

SEQ ID NO: 11405 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccuaccgcccggcuaatt

SEQ ID NO: 11406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuagccgggcgguaggugutt

SEQ ID NO: 11407 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagcgauuuaagaaccgtt

SEQ ID NO: 11408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguucuuaaaucgcuugutt

SEQ ID NO: 11409 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgguauuucuucuacucgtt

SEQ ID NO: 11410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaguagaagaaauaccgctt

SEQ ID NO: 11411 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucuaugucaaguuguatt

SEQ ID NO: 11412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaacuugacauagaucatt

SEQ ID NO: 11413 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagucuagccuauauccatt

SEQ ID NO: 11414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggauauaggcuagacuuctt

SEQ ID NO: 11415 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuagccuauauccauuctt

SEQ ID NO: 11416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauggauauaggcuagactt

SEQ ID NO: 11417 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuagccuauauccauucctt

SEQ ID NO: 11418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaauggauauaggcuagatt

SEQ ID NO: 11419 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugcuaggacaaccaauatt

SEQ ID NO: 11420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauugguuguccuagcaactt

SEQ ID NO: 11421 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguagcaugaaaguuagtt

SEQ ID NO: 11422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaacuuucaugcuaccaatt

SEQ ID NO: 11423 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauacagacacgaaagugtt

SEQ ID NO: 11424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuuucgugucuguauaatt

SEQ ID NO: 11425 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcgauuuaagaaccgatt

SEQ ID NO: 11426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguucuuaaaucgcuugtt

SEQ ID NO: 11427 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaugagaaagcuagactt

SEQ ID NO: 11428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuagcuuucucaugauctt

SEQ ID NO: 11429 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuaccuuaaccuggugctt

SEQ ID NO: 11430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaccagguuaagguagactt

SEQ ID NO: 11431 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguuccggagacaguguatt

SEQ ID NO: 11432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacacugucuccggaacautt

SEQ ID NO: 11433 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagucgccagacacuauagtt

SEQ ID NO: 11434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauagugucuggcgacuctt

SEQ ID NO: 11435 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucgccagacacuauaguctt

SEQ ID NO: 11436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuauagugucuggcgactt

SEQ ID NO: 11437 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacuauagucgagccaatt

SEQ ID NO: 11438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcucgacuauaguguctt

SEQ ID NO: 11439 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacacucccugugaucuatt

SEQ ID NO: 11440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaucacagggagugucutt

SEQ ID NO: 11441 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucuaugucaaguuguautt

SEQ ID NO: 11442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacaacuugacauagauctt

SEQ ID NO: 11443 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauguaucagcuguucagatt

SEQ ID NO: 11444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugaacagcugauacauatt

SEQ ID NO: 11445 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuggaaucugccaucgatt

SEQ ID NO: 11446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgauggcagauuccaaagtt

SEQ ID NO: 11447 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuacagggcaccagaguutt

SEQ ID NO: 11448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacucuggugcccuguagutt

SEQ ID NO: 11449 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguguggaucaguuggutt

SEQ ID NO: 11450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaacugauccacaccactt

SEQ ID NO: 11451 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggagcaaauuagagaaatt

SEQ ID NO: 11452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucucuaauuugcucccutt

SEQ ID NO: 11453 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaaaucaaggcacauctt

SEQ ID NO: 11454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaugugccuugauuugaggtt

SEQ ID NO: 11455 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuggaguacacaccuatt

SEQ ID NO: 11456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagguguguacuccagcagtt

SEQ ID NO: 11457 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaagguaaccacaguagutt

SEQ ID NO: 11458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuacugugguuaccuugctt

SEQ ID NO: 11459 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcagacacucccugugtt

SEQ ID NO: 11460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagggagugucugcuugtt

SEQ ID NO: 11461 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcagcaagguaaccatt

SEQ ID NO: 11462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguuaccuugcugccauctt

SEQ ID NO: 11463 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaccacaguaguggcaactt

SEQ ID NO: 11464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugccacuacugugguuatt

SEQ ID NO: 11465 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggacaagcgauuuaagatt

SEQ ID NO: 11466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuaaaucgcuuguccugtt

SEQ ID NO: 11467 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagaucaugagaaagcutt

SEQ ID NO: 11468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuucucaugaucuggatt

SEQ ID NO: 11469 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgacugcgguauuucuutt

SEQ ID NO: 11470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaauaccgcagucggatt

SEQ ID NO: 11471 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacagagucgccagacactt

SEQ ID NO: 11472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucuggcgacucuguactt

SEQ ID NO: 11473 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugaucuaugucaaguugutt

SEQ ID NO: 11474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaacuugacauagaucactt

SEQ ID NO: 11475 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugccaucgagacauuaatt

SEQ ID NO: 11476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaugucucgauggcagatt

SEQ ID NO: 11477 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacugauuacacguccagtt

SEQ ID NO: 11478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggacguguaaucaguggtt

SEQ ID NO: 11479 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauagauguauggucugctt

SEQ ID NO: 11480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagaccauacaucuauactt

SEQ ID NO: 11481 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguguuggcugaauugutt

SEQ ID NO: 11482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaauucagccaacacacatt

SEQ ID NO: 11483 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaauuguugcuaggacaatt

SEQ ID NO: 11484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccuagcaacaauucatt

SEQ ID NO: 11485 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccucaaaucaaggcacautt

SEQ ID NO: 11486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augugccuugauuugagggtt

SEQ ID NO: 11487 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuggacaaaggucuucctt

SEQ ID NO: 11488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagaccuuuguccaaggtt

SEQ ID NO: 11489 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagaggcaauugcacugtt

SEQ ID NO: 11490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugcaauugccucuggutt

SEQ ID NO: 11491 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagcuuuugguagcaugatt

SEQ ID NO: 11492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaugcuaccaaaagcugatt

SEQ ID NO: 11493 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaaaguuagcagagauatt

SEQ ID NO: 11494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucucugcuaacuuucautt

SEQ ID NO: 11495 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauggcagcaagguaacctt

SEQ ID NO: 11496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuaccuugcugccaucutt

SEQ ID NO: 11497 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcaagguaaccacagutt

SEQ ID NO: 11498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugugguuaccuugcugctt

SEQ ID NO: 11499 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaggguccugacaggctt

SEQ ID NO: 11500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccugucaggacccuggcctt

SEQ ID NO: 11501 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagucaguuauacagacactt

SEQ ID NO: 11502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucuguauaacugacuutt

SEQ ID NO: 11503 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuggaaauggaucauuugtt

SEQ ID NO: 11504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaugauccauuuccaautt

SEQ ID NO: 11505 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggaaauggaucauuuggtt

SEQ ID NO: 11506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaaugauccauuuccaatt

SEQ ID NO: 11507 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugugguauaucaagcctt

SEQ ID NO: 11508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuugauauaccacaccatt

SEQ ID NO: 11509 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccaaacuuugugauuctt

SEQ ID NO: 11510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaucacaaaguuuggcuutt

SEQ ID NO: 11511 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauucuggagaacugguugtt

SEQ ID NO: 11512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaccaguucuccagaauctt

SEQ ID NO: 11513 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucuggagaacugguugctt

SEQ ID NO: 11514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaccaguucuccagaautt

SEQ ID NO: 11515 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggagaacugguugccatt

SEQ ID NO: 11516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcaaccaguucuccagatt

SEQ ID NO: 11517 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuacaggacaagcgauuutt

SEQ ID NO: 11518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaucgcuuguccuguagatt

SEQ ID NO: 11519 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagaccacuguaacauatt

SEQ ID NO: 11520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauguuacaguggucuagctt

SEQ ID NO: 11521 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaagaaagaugaggucutt

SEQ ID NO: 11522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaccucaucuuucuucuctt

SEQ ID NO: 11523 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagaaagaugaggucuatt

SEQ ID NO: 11524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaccucaucuuucuucutt

SEQ ID NO: 11525 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagaugaggucuaccuuatt

SEQ ID NO: 11526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagguagaccucaucuuutt

SEQ ID NO: 11527 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaugaggucuaccuuaatt

SEQ ID NO: 11528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaagguagaccucaucuutt

SEQ ID NO: 11529 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauguuccggagacagugutt

SEQ ID NO: 11530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacugucuccggaacauatt

SEQ ID NO: 11531 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguguacagagucgccatt

SEQ ID NO: 11532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcgacucuguacacugutt

SEQ ID NO: 11533 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacacucccugugaucuautt

SEQ ID NO: 11534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagaucacagggaguguctt

SEQ ID NO: 11535 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacucccugugaucuaugutt

SEQ ID NO: 11536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauagaucacagggagugtt

SEQ ID NO: 11537 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauauguaucagcuguuctt

SEQ ID NO: 11538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacagcugauacauauactt

SEQ ID NO: 11539 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacagaaccucuuguugtt

SEQ ID NO: 11540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacaagagguucuguggutt

SEQ ID NO: 11541 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccucuuguuggauccugtt

SEQ ID NO: 11542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggauccaacaagagguutt

SEQ ID NO: 11543 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccugauacagcuguauutt

SEQ ID NO: 11544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauacagcuguaucaggautt

SEQ ID NO: 11545 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagcuguauuaaaacuctt

SEQ ID NO: 11546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguuuuaauacagcuguatt

SEQ ID NO: 11547 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcagcugguccgaggagtt

SEQ ID NO: 11548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccucggaccagcugcuutt

SEQ ID NO: 11549 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauguuucauauaucugutt

SEQ ID NO: 11550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagauauaugaaacauugtt

SEQ ID NO: 11551 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaucuguucucgguacutt

SEQ ID NO: 11552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaccgagaacagauauatt

SEQ ID NO: 11553 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucucgguacuacagggctt

SEQ ID NO: 11554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccuguaguaccgagaactt

SEQ ID NO: 11555 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcaccagaguugaucuutt

SEQ ID NO: 11556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaucaacucuggugccctt

SEQ ID NO: 11557 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagaguugaucuuuggatt

SEQ ID NO: 11558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaagaucaacucuggutt

SEQ ID NO: 11559 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuggagccacugauuactt

SEQ ID NO: 11560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaucaguggcuccaaagtt

SEQ ID NO: 11561 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccacugauuacacgucctt

SEQ ID NO: 11562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacguguaaucaguggcutt

SEQ ID NO: 11563 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaguauagauguauggutt

SEQ ID NO: 11564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accauacaucuauacuggatt

SEQ ID NO: 11565 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguguggaucaguuggugtt

SEQ ID NO: 11566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaacugauccacaccatt

SEQ ID NO: 11567 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaagguccuaggaacacctt

SEQ ID NO: 11568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguuccuaggaccuuuatt

SEQ ID NO: 11569 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguccuaggaacaccaatt

SEQ ID NO: 11570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguguuccuaggaccuutt

SEQ ID NO: 11571 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguccuaggaacaccaactt

SEQ ID NO: 11572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugguguuccuaggaccutt

SEQ ID NO: 11573 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggaacaccaacaagggatt

SEQ ID NO: 11574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccuuguugguguuccuatt

SEQ ID NO: 11575 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacaagggagcaaauuagtt

SEQ ID NO: 11576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaauuugcucccuuguugtt

SEQ ID NO: 11577 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaaaugaacccaaauuatt

SEQ ID NO: 11578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauuuggguucauuucuctt

SEQ ID NO: 11579 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuauacagaauucaaauutt

SEQ ID NO: 11580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuugaauucuguauaautt

SEQ ID NO: 11581 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaauucaaauucccucaatt

SEQ ID NO: 11582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugagggaauuugaauucutt

SEQ ID NO: 11583 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauucaaauucccucaaatt

SEQ ID NO: 11584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugagggaauuugaauuctt

SEQ ID NO: 11585 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccucaaaucaaggcacatt

SEQ ID NO: 11586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugccuugauuugagggatt

SEQ ID NO: 11587 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccuuggacaaaggucuutt

SEQ ID NO: 11588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaccuuuguccaaggautt

SEQ ID NO: 11589 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggacaaaggucuuccgtt

SEQ ID NO: 11590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaagaccuuuguccaagtt

SEQ ID NO: 11591 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccagaggcaauugcacutt

SEQ ID NO: 11592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcaauugccucuggugtt

SEQ ID NO: 11593 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacugugcagccgucugctt

SEQ ID NO: 11594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagacggcugcacagugctt

SEQ ID NO: 11595 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacugugcagccgucugcutt

SEQ ID NO: 11596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagacggcugcacagugtt

SEQ ID NO: 11597 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuggaagcuugugcactt

SEQ ID NO: 11598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcacaagcuuccaguggtt

SEQ ID NO: 11599 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagcugcaagccagugctt

SEQ ID NO: 11600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacuggcuugcagcucuctt

SEQ ID NO: 11601 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaggaagucaguuauatt

SEQ ID NO: 11602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaacugacuuccuguggtt

SEQ ID NO: 11603 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaggucuaccuuaaccutt

SEQ ID NO: 11604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguuaagguagaccucautt

SEQ ID NO: 11605 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuggcugaauuguugcutt

SEQ ID NO: 11606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaacaauucagccaacatt

SEQ ID NO: 11607 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauuguugcuaggacaactt

SEQ ID NO: 11608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuguccuagcaacaauuctt

SEQ ID NO: 11609 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcagccuucagcuuuutt

SEQ ID NO: 11610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaagcugaaggcugcugctt

SEQ ID NO: 11611 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcagccuucagcuuuugtt

SEQ ID NO: 11612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaagcugaaggcugcugtt

SEQ ID NO: 11613 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcagcaagguaaccactt

SEQ ID NO: 11614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguuaccuugcugccautt

SEQ ID NO: 11615 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcaacuccuggccagtt

SEQ ID NO: 11616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggccaggaguugccacutt

SEQ ID NO: 11617 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaaacuuugugauucugtt

SEQ ID NO: 11618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaaucacaaaguuuggctt

SEQ ID NO: 11619 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaaguucuacaggacatt

SEQ ID NO: 11620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccuguagaacuuucuutt

SEQ ID NO: 11621 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacuauguuccggagactt

SEQ ID NO: 11622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuccggaacauaguccatt

SEQ ID NO: 11623 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcagacacucccugugatt

SEQ ID NO: 11624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacagggagugucugcuutt

SEQ ID NO: 11625 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccugugaucuaugucaagtt

SEQ ID NO: 11626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugacauagaucacagggtt

SEQ ID NO: 11627 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuguuggauccugauactt

SEQ ID NO: 11628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaucaggauccaacaagatt

SEQ ID NO: 11629 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggauccugauacagcugtt

SEQ ID NO: 11630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuguaucaggauccaatt

SEQ ID NO: 11631 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauaucuguucucgguactt

SEQ ID NO: 11632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaccgagaacagauauautt

SEQ ID NO: 11633 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaguugaucuuuggagcctt

SEQ ID NO: 11634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuccaaagaucaacucutt

SEQ ID NO: 11635 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggcuguguguuggcugatt

SEQ ID NO: 11636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagccaacacacagccugtt

SEQ ID NO: 11637 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcugaauuguugcuagtt

SEQ ID NO: 11638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagcaacaauucagccaatt

SEQ ID NO: 11639 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaccaauauuuccuggggtt

SEQ ID NO: 11640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccaggaaauauugguugtt

SEQ ID NO: 11641 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaguugguggaaauaatt

SEQ ID NO: 11642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauuuccaccaacugauctt

SEQ ID NO: 11643 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaccagaggcaauugcatt

SEQ ID NO: 11644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaauugccucugguggatt

SEQ ID NO: 11645 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcccggcuaacaccacugtt

SEQ ID NO: 11646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugguguuagccgggcgtt

SEQ ID NO: 11647 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccggcuaacaccacuggtt

SEQ ID NO: 11648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagugguguuagccgggctt

SEQ ID NO: 11649 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauagucgagccaagcagatt

SEQ ID NO: 11650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcuuggcucgacuauatt

SEQ ID NO: 11651 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacgaaagugauuggaaautt

SEQ ID NO: 11652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuccaaucacuuucgugtt

SEQ ID NO: 11653 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacaagcgauuuaagaatt

SEQ ID NO: 11654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuuaaaucgcuuguccutt

SEQ ID NO: 11655 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgaccgagaaccaccucctt

SEQ ID NO: 11656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaggugguucucggucgctt

SEQ ID NO: 11657 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggucuaccuuaaccuggutt

SEQ ID NO: 11658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagguuaagguagaccutt

SEQ ID NO: 11659 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggagacaguguacagagtt

SEQ ID NO: 11660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuguacacugucuccggtt

SEQ ID NO: 11661 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucgagccaagcagacactt

SEQ ID NO: 11662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugucugcuuggcucgacutt

SEQ ID NO: 11663 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccaucgagacauuaaatt

SEQ ID NO: 11664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaaugucucgauggcagtt

SEQ ID NO: 11665 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcccaauguuucauautt

SEQ ID NO: 11666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaugaaacauugggcucutt

SEQ ID NO: 11667 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgguacuacagggcaccatt

SEQ ID NO: 11668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugcccuguaguaccgatt

SEQ ID NO: 11669 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauaauaaagguccuaggatt

SEQ ID NO: 11670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuaggaccuuuauuauutt

SEQ ID NO: 11671 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcaaauuagagaaaugatt

SEQ ID NO: 11672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauuucucuaauuugcuctt

SEQ ID NO: 11673 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgcccggcuaacaccatt

SEQ ID NO: 11674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguguuagccgggcgguatt

SEQ ID NO: 11675 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augucggggcgaccgagaatt

SEQ ID NO: 11676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucggucgccccgacautt

SEQ ID NO: 11677 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaccgagaaccaccuccutt

SEQ ID NO: 11678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaggugguucucggucgtt

SEQ ID NO: 11679 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugcggagagcugcaagctt

SEQ ID NO: 11680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuugcagcucuccgcaaatt

SEQ ID NO: 11681 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaagguaaccacaguagtt

SEQ ID NO: 11682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacugugguuaccuugcutt

SEQ ID NO: 11683 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguaaccacaguaguggcatt

SEQ ID NO: 11684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccacuacugugguuacctt

SEQ ID NO: 11685 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagucaguuauacagacatt

SEQ ID NO: 11686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucuguauaacugacuuctt

SEQ ID NO: 11687 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucaguuauacagacacgtt

SEQ ID NO: 11688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgugucuguauaacugacutt

SEQ ID NO: 11689 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacgaaagugauuggaaatt

SEQ ID NO: 11690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuccaaucacuuucgugutt

SEQ ID NO: 11691 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acgaaagugauuggaaaugtt

SEQ ID NO: 11692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuuccaaucacuuucgutt

SEQ ID NO: 11693 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagugauuggaaauggautt

SEQ ID NO: 11694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccauuuccaaucacuuutt

SEQ ID NO: 11695 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaucaagccaaacuuugutt

SEQ ID NO: 11696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaaguuuggcuugauautt

SEQ ID NO: 11697 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccaaacuuugugauucutt

SEQ ID NO: 11698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaucacaaaguuuggcutt

SEQ ID NO: 11699 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucaagaaaguucuacatt

SEQ ID NO: 11700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguagaacuuucuugauggtt

SEQ ID NO: 11701 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucaagaaaguucuacagtt

SEQ ID NO: 11702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguagaacuuucuugaugtt

SEQ ID NO: 11703 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuacaggacaagcgautt

SEQ ID NO: 11704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgcuuguccuguagaactt

SEQ ID NO: 11705 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaugagaaagcuagacctt

SEQ ID NO: 11706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucuagcuuucucaugautt

SEQ ID NO: 11707 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuucuacucgaguggugtt

SEQ ID NO: 11708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccacucgaguagaagaatt

SEQ ID NO: 11709 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgaguggugagaagaaatt

SEQ ID NO: 11710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuucucaccacucgagtt

SEQ ID NO: 11711 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuaaccuggugcuggacutt

SEQ ID NO: 11712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguccagcaccagguuaagtt

SEQ ID NO: 11713 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccuggugcuggacuaugtt

SEQ ID NO: 11714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauaguccagcaccagguutt

SEQ ID NO: 11715 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggagacaguguacagatt

SEQ ID NO: 11716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguacacugucuccggatt

SEQ ID NO: 11717 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguguacagagucgccagatt

SEQ ID NO: 11718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggcgacucuguacacutt

SEQ ID NO: 11719 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacagagucgccagactt

SEQ ID NO: 11720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucuggcgacucuguacactt

SEQ ID NO: 11721 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagagucgccagacacutt

SEQ ID NO: 11722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugucuggcgacucuguatt

SEQ ID NO: 11723 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagucgccagacacuauatt

SEQ ID NO: 11724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauagugucuggcgacucutt

SEQ ID NO: 11725 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucgccagacacuauagutt

SEQ ID NO: 11726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuauagugucuggcgacutt

SEQ ID NO: 11727 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagucgagccaagcagacatt

SEQ ID NO: 11728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucugcuuggcucgacuatt

SEQ ID NO: 11729 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugaucuaugucaaguugtt

SEQ ID NO: 11730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacuugacauagaucacatt

SEQ ID NO: 11731 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuaugucaaguuguauatt

SEQ ID NO: 11732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacaacuugacauagautt

SEQ ID NO: 11733 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuaugucaaguuguauautt

SEQ ID NO: 11734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauacaacuugacauagatt

SEQ ID NO: 11735 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguuguauauguaucagctt

SEQ ID NO: 11736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugauacauauacaacuutt

SEQ ID NO: 11737 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuguauauguaucagcutt

SEQ ID NO: 11738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugauacauauacaacutt

SEQ ID NO: 11739 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauauguaucagcuguutt

SEQ ID NO: 11740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacagcugauacauauacatt

SEQ ID NO: 11741 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauguaucagcuguucagtt

SEQ ID NO: 11742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaacagcugauacauautt

SEQ ID NO: 11743 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggaaucugccaucgagtt

SEQ ID NO: 11744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgauggcagauuccaaatt

SEQ ID NO: 11745 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacagcuguauuaaaacutt

SEQ ID NO: 11746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuuuaauacagcuguautt

SEQ ID NO: 11747 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauuaaaacucugugactt

SEQ ID NO: 11748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucacagaguuuuaauacatt

SEQ ID NO: 11749 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggagagcccaauguuuctt

SEQ ID NO: 11750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaacauugggcucuccuctt

SEQ ID NO: 11751 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcccaauguuucauauauctt

SEQ ID NO: 11752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauauaugaaacauugggctt

SEQ ID NO: 11753 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucauauaucuguucucgtt

SEQ ID NO: 11754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagaacagauauaugaaatt

SEQ ID NO: 11755 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaucuguucucgguacuatt

SEQ ID NO: 11756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguaccgagaacagauautt

SEQ ID NO: 11757 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguacuacagggcaccagtt

SEQ ID NO: 11758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggugcccuguaguaccgtt

SEQ ID NO: 11759 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaguauagauguaugguctt

SEQ ID NO: 11760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccauacaucuauacuggtt

SEQ ID NO: 11761 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguugcuaggacaaccaatt

SEQ ID NO: 11762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguuguccuagcaacaatt

SEQ ID NO: 11763 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguugcuaggacaaccaautt

SEQ ID NO: 11764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugguuguccuagcaacatt

SEQ ID NO: 11765 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguugguggaaauaauaatt

SEQ ID NO: 11766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauuauuuccaccaacugtt

SEQ ID NO: 11767 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaaauuagagaaaugaatt

SEQ ID NO: 11768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucauuucucuaauuugcutt

SEQ ID NO: 11769 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaaauuauacagaauuctt

SEQ ID NO: 11770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauucuguauaauuugggtt

SEQ ID NO: 11771 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucccucaaaucaaggctt

SEQ ID NO: 11772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuugauuugagggaauutt

SEQ ID NO: 11773 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaucaaggcacauccuugtt

SEQ ID NO: 11774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggaugugccuugauuutt

SEQ ID NO: 11775 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccgaacuccaccagaggctt

SEQ ID NO: 11776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccucugguggaguucgggtt

SEQ ID NO: 11777 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgucugcuggaguacacatt

SEQ ID NO: 11778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguacuccagcagacggtt

SEQ ID NO: 11779 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguacacaccuaccgccctt

SEQ ID NO: 11780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcgguagguguguacuctt

SEQ ID NO: 11781 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaucaugagaaagcuatt

SEQ ID NO: 11782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcuuucucaugaucuggtt

SEQ ID NO: 11783 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagccuauauccauuccutt

SEQ ID NO: 11784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaauggauauaggcuagtt

SEQ ID NO: 11785 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagcccaauguuucauatt

SEQ ID NO: 11786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaugaaacauugggcucuctt

SEQ ID NO: 11787 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguacuacagggcaccagatt

SEQ ID NO: 11788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggugcccuguaguacctt

SEQ ID NO: 11789 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagggcaccagaguugautt

SEQ ID NO: 11790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaacucuggugcccugutt

SEQ ID NO: 11791 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaucaguugguggaaauatt

SEQ ID NO: 11792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuuccaccaacugaucctt

SEQ ID NO: 11793 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaaaggucuuccggccctt

SEQ ID NO: 11794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggccggaagaccuuuguctt

SEQ ID NO: 11795 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggugcuggacuauguuctt

SEQ ID NO: 11796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacauaguccagcaccagtt

SEQ ID NO: 11797 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggcgaccgagaaccactt

SEQ ID NO: 11798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguucucggucgccccgtt

SEQ ID NO: 11799 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuuugcggagagcugctt

SEQ ID NO: 11800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcucuccgcaaaggagtt

SEQ ID NO: 11801 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuugcggagagcugcatt

SEQ ID NO: 11802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagcucuccgcaaaggatt

SEQ ID NO: 11803 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagagauaaagauggcatt

SEQ ID NO: 11804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaucuuuaucucugcutt

SEQ ID NO: 11805 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguaguggcaacuccuggctt

SEQ ID NO: 11806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaggaguugccacuacutt

SEQ ID NO: 11807 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaguggcaacuccuggcctt

SEQ ID NO: 11808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccaggaguugccacuactt

SEQ ID NO: 11809 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacacgaaagugauuggatt

SEQ ID NO: 11810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaucacuuucgugucutt

SEQ ID NO: 11811 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagugauuggaaauggauctt

SEQ ID NO: 11812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauccauuuccaaucacuutt

SEQ ID NO: 11813 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucauuuggugugguauatt

SEQ ID NO: 11814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaccacaccaaaugauctt

SEQ ID NO: 11815 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugugguauaucaagccaatt

SEQ ID NO: 11816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggcuugauauaccacactt

SEQ ID NO: 11817 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguauaucaagccaaacutt

SEQ ID NO: 11818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuuggcuugauauaccatt

SEQ ID NO: 11819 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguauaucaagccaaacuutt

SEQ ID NO: 11820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguuuggcuugauauacctt

SEQ ID NO: 11821 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauaucaagccaaacuuutt

SEQ ID NO: 11822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaguuuggcuugauauactt

SEQ ID NO: 11823 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguugccaucaagaaaguutt

SEQ ID NO: 11824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuuucuugauggcaacctt

SEQ ID NO: 11825 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuuaagaaccgagagcutt

SEQ ID NO: 11826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucucgguucuuaaauctt

SEQ ID NO: 11827 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaagaaccgagagcucctt

SEQ ID NO: 11828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcucucgguucuuaaatt

SEQ ID NO: 11829 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaucaugagaaagcuagatt

SEQ ID NO: 11830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuagcuuucucaugaucutt

SEQ ID NO: 11831 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaagcuagaccacuguaatt

SEQ ID NO: 11832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacaguggucuagcuuuctt

SEQ ID NO: 11833 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcuagaccacuguaactt

SEQ ID NO: 11834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuacaguggucuagcuuutt

SEQ ID NO: 11835 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacugcgguauuucuucutt

SEQ ID NO: 11836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaagaaauaccgcagucgtt

SEQ ID NO: 11837 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacugcgguauuucuucuatt

SEQ ID NO: 11838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaagaaauaccgcaguctt

SEQ ID NO: 11839 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucgaguggugagaagaatt

SEQ ID NO: 11840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuucucaccacucgagutt

SEQ ID NO: 11841 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaguggugagaagaaagtt

SEQ ID NO: 11842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucuucucaccacucgatt

SEQ ID NO: 11843 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaggucuaccuuaaccugtt

SEQ ID NO: 11844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagguuaagguagaccucatt

SEQ ID NO: 11845 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaccuggugcuggacuatt

SEQ ID NO: 11846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaguccagcaccagguuaatt

SEQ ID NO: 11847 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuauguuccggagacagutt

SEQ ID NO: 11848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugucuccggaacauagutt

SEQ ID NO: 11849 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuccggagacaguguacatt

SEQ ID NO: 11850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacacugucuccggaactt

SEQ ID NO: 11851 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagacaguguacagagucgtt

SEQ ID NO: 11852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgacucuguacacugucuctt

SEQ ID NO: 11853 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgccagacacuauagucgatt

SEQ ID NO: 11854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgacuauagugucuggcgtt

SEQ ID NO: 11855 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucccugugaucuauguctt

SEQ ID NO: 11856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacauagaucacagggagutt

SEQ ID NO: 11857 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucccugugaucuaugucaatt

SEQ ID NO: 11858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugacauagaucacagggatt

SEQ ID NO: 11859 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaugucaaguuguauaugutt

SEQ ID NO: 11860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauauacaacuugacauatt

SEQ ID NO: 11861 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguauauguaucagcugutt

SEQ ID NO: 11862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcugauacauauacaatt

SEQ ID NO: 11863 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauuaaaccacagaaccutt

SEQ ID NO: 11864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguucugugguuuaaugutt

SEQ ID NO: 11865 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagaaccucuuguuggautt

SEQ ID NO: 11866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccaacaagagguucugutt

SEQ ID NO: 11867 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccucuuguuggaucctt

SEQ ID NO: 11868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauccaacaagagguucutt

SEQ ID NO: 11869 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguuggauccugauacagtt

SEQ ID NO: 11870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaucaggauccaacaatt

SEQ ID NO: 11871 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauccugauacagcuguautt

SEQ ID NO: 11872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacagcuguaucaggauctt

SEQ ID NO: 11873 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauacagcuguauuaaaactt

SEQ ID NO: 11874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuuaauacagcuguauctt

SEQ ID NO: 11875 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaagcagcugguccgagtt

SEQ ID NO: 11876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucggaccagcugcuuugctt

SEQ ID NO: 11877 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaggagagcccaauguuutt

SEQ ID NO: 11878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacauugggcucuccucgtt

SEQ ID NO: 11879 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcccaauguuucauauautt

SEQ ID NO: 11880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauaugaaacauugggcutt

SEQ ID NO: 11881 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaguugaucuuuggagtt

SEQ ID NO: 11882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccaaagaucaacucuggtt

SEQ ID NO: 11883 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaguugaucuuuggagctt

SEQ ID NO: 11884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccaaagaucaacucugtt

SEQ ID NO: 11885 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacugauuacacguccatt

SEQ ID NO: 11886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacguguaaucaguggctt

SEQ ID NO: 11887 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagauguauggucugcagtt

SEQ ID NO: 11888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcagaccauacaucuautt

SEQ ID NO: 11889 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauggucugcaggcugugtt

SEQ ID NO: 11890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagccugcagaccauactt

SEQ ID NO: 11891 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuguugcuaggacaaccatt

SEQ ID NO: 11892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguuguccuagcaacaautt

SEQ ID NO: 11893 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaaccaauauuuccuggtt

SEQ ID NO: 11894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggaaauauugguuguctt

SEQ ID NO: 11895 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauuuccuggggacagugtt

SEQ ID NO: 11896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuguccccaggaaauautt

SEQ ID NO: 11897 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggaucaguugguggaatt

SEQ ID NO: 11898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaccaacugauccacatt

SEQ ID NO: 11899 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaagggagcaaauuagatt

SEQ ID NO: 11900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuaauuugcucccuuguutt

SEQ ID NO: 11901 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagcaaauuagagaaaugtt

SEQ ID NO: 11902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuucucuaauuugcucctt

SEQ ID NO: 11903 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccaaauuauacagaauutt

SEQ ID NO: 11904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucuguauaauuugggutt

SEQ ID NO: 11905 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaucaaggcacauccuutt

SEQ ID NO: 11906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggaugugccuugauuugtt

SEQ ID NO: 11907 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaggcacauccuuggactt

SEQ ID NO: 11908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccaaggaugugccuugatt

SEQ ID NO: 11909 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccggccccgaacuccactt

SEQ ID NO: 11910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggaguucggggccggaatt

SEQ ID NO: 11911 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccgucugcuggaguactt

SEQ ID NO: 11912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuccagcagacggcugtt

SEQ ID NO: 11913 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccgucugcuggaguacatt

SEQ ID NO: 11914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacuccagcagacggcutt

SEQ ID NO: 11915 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccgucugcuggaguacactt

SEQ ID NO: 11916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguacuccagcagacggctt

SEQ ID NO: 11917 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuggaguacacaccuactt

SEQ ID NO: 11918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagguguguacuccagcatt

SEQ ID NO: 11919 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucggggcgaccgagaactt

SEQ ID NO: 11920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucucggucgccccgacatt

SEQ ID NO: 11921 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggcgaccgagaaccacctt

SEQ ID NO: 11922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugguucucggucgcccctt

SEQ ID NO: 11923 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccgagaaccaccuccuutt

SEQ ID NO: 11924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggaggugguucucgguctt

SEQ ID NO: 11925 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccaccuccuuugcggatt

SEQ ID NO: 11926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgcaaaggaggugguuctt

SEQ ID NO: 11927 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugcggagagcugcaagtt

SEQ ID NO: 11928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugcagcucuccgcaaagtt

SEQ ID NO: 11929 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcggagagcugcaagccagtt

SEQ ID NO: 11930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggcuugcagcucuccgctt

SEQ ID NO: 11931 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcaagccagugcagcagtt

SEQ ID NO: 11932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcugcacuggcuugcagtt

SEQ ID NO: 11933 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagugcagcagccuucagctt

SEQ ID NO: 11934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugaaggcugcugcacugtt

SEQ ID NO: 11935 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagccuucagcuuuuggtt

SEQ ID NO: 11936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaaagcugaaggcugcutt

SEQ ID NO: 11937 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagccuucagcuuuuggutt

SEQ ID NO: 11938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaaaagcugaaggcugctt

SEQ ID NO: 11939 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuucagcuuuugguagtt

SEQ ID NO: 11940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccaaaagcugaaggcutt

SEQ ID NO: 11941 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuucagcuuuugguagctt

SEQ ID NO: 11942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaccaaaagcugaaggctt

SEQ ID NO: 11943 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucagcuuuugguagcaugtt

SEQ ID NO: 11944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugcuaccaaaagcugaatt

SEQ ID NO: 11945 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuuuugguagcaugaatt

SEQ ID NO: 11946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaugcuaccaaaagcugtt

SEQ ID NO: 11947 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuuugguagcaugaaatt

SEQ ID NO: 11948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucaugcuaccaaaagcutt

SEQ ID NO: 11949 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaugaaaguuagcagagtt

SEQ ID NO: 11950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugcuaacuuucaugcutt

SEQ ID NO: 11951 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaaguuagcagagauaatt

SEQ ID NO: 11952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaucucugcuaacuuucatt

SEQ ID NO: 11953 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaagauggcagcaagguatt

SEQ ID NO: 11954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccuugcugccaucuuuatt

SEQ ID NO: 11955 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagauggcagcaagguaatt

SEQ ID NO: 11956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaccuugcugccaucuuutt

SEQ ID NO: 11957 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagcaagguaaccacagtt

SEQ ID NO: 11958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugguuaccuugcugcctt

SEQ ID NO: 11959 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaagguaaccacaguatt

SEQ ID NO: 11960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacugugguuaccuugcugtt

SEQ ID NO: 11961 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccacaguaguggcaacutt

SEQ ID NO: 11962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguugccacuacugugguutt

SEQ ID NO: 11963 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacaguaguggcaacuctt

SEQ ID NO: 11964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguugccacuacuguggutt

SEQ ID NO: 11965 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcaacuccuggccaggtt

SEQ ID NO: 11966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggccaggaguugccactt

SEQ ID NO: 11967 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaacuccuggccagggutt

SEQ ID NO: 11968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccuggccaggaguugcctt

SEQ ID NO: 11969 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaacuccuggccaggguctt

SEQ ID NO: 11970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacccuggccaggaguugctt

SEQ ID NO: 11971 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuccuggccaggguccutt

SEQ ID NO: 11972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacccuggccaggaguutt

SEQ ID NO: 11973 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugacaggccacaggaatt

SEQ ID NO: 11974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuguggccugucaggatt

SEQ ID NO: 11975 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugacaggccacaggaagtt

SEQ ID NO: 11976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccuguggccugucaggtt

SEQ ID NO: 11977 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacaggccacaggaaguctt

SEQ ID NO: 11978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuuccuguggccugucatt

SEQ ID NO: 11979 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacaggccacaggaagucatt

SEQ ID NO: 11980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacuuccuguggccuguctt

SEQ ID NO: 11981 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaguuauacagacacgatt

SEQ ID NO: 11982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgugucuguauaacugactt

SEQ ID NO: 11983 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguuauacagacacgaaatt

SEQ ID NO: 11984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucgugucuguauaacugtt

SEQ ID NO: 11985 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuauacagacacgaaagutt

SEQ ID NO: 11986 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuucgugucuguauaactt

SEQ ID NO: 11987 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacagacacgaaagugatt

SEQ ID NO: 11988 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacuuucgugucuguauatt

SEQ ID NO: 11989 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagacacgaaagugauutt

SEQ ID NO: 11990 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucacuuucgugucuguatt

SEQ ID NO: 11991 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaaagugauuggaaauggtt

SEQ ID NO: 11992 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauuuccaaucacuuucgtt

SEQ ID NO: 11993 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauuggaaauggaucauutt

SEQ ID NO: 11994 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugauccauuuccaaucatt

SEQ ID NO: 11995 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaucauuuggugugguatt

SEQ ID NO: 11996 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccacaccaaaugauccatt

SEQ ID NO: 11997 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucauuuggugugguauauctt

SEQ ID NO: 11998 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauauaccacaccaaaugatt

SEQ ID NO: 11999 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugguauaucaagccaaatt

SEQ ID NO: 12000 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggcuugauauaccacatt

SEQ ID NO: 12001 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaucaagccaaacuuugtt

SEQ ID NO: 12002 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaguuuggcuugauauatt

SEQ ID NO: 12003 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucaagccaaacuuugugtt

SEQ ID NO: 12004 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaaaguuuggcuugauatt

SEQ ID NO: 12005 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagccaaacuuugugatt

SEQ ID NO: 12006 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacaaaguuuggcuugautt

SEQ ID NO: 12007 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugugauucuggagaacutt

SEQ ID NO: 12008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucuccagaaucacaaatt

SEQ ID NO: 12009 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagaacugguugccauctt

SEQ ID NO: 12010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcaaccaguucuccatt

SEQ ID NO: 12011 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagaacugguugccaucatt

SEQ ID NO: 12012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauggcaaccaguucucctt

SEQ ID NO: 12013 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguugccaucaagaaagutt

SEQ ID NO: 12014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuucuugauggcaaccatt

SEQ ID NO: 12015 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugccaucaagaaaguuctt

SEQ ID NO: 12016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuuucuugauggcaactt

SEQ ID NO: 12017 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugccaucaagaaaguucutt

SEQ ID NO: 12018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaacuuucuugauggcaatt

SEQ ID NO: 12019 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaagaaaguucuacaggtt

SEQ ID NO: 12020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuguagaacuuucuugautt

SEQ ID NO: 12021 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguucuacaggacaagcgatt

SEQ ID NO: 12022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgcuuguccuguagaacutt

SEQ ID NO: 12023 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuacaggacaagcgauuuatt

SEQ ID NO: 12024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaucgcuuguccuguagtt

SEQ ID NO: 12025 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaccgagagcuccagautt

SEQ ID NO: 12026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuggagcucucgguucutt

SEQ ID NO: 12027 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagagcuccagaucaugtt

SEQ ID NO: 12028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugaucuggagcucucggtt

SEQ ID NO: 12029 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuccagaucaugagaaatt

SEQ ID NO: 12030 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucucaugaucuggagcutt

SEQ ID NO: 12031 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuccagaucaugagaaagtt

SEQ ID NO: 12032 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucucaugaucuggagctt

SEQ ID NO: 12033 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccagaucaugagaaagctt

SEQ ID NO: 12034 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuucucaugaucuggagtt

SEQ ID NO: 12035 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaucaugagaaagcuagtt

SEQ ID NO: 12036 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagcuuucucaugaucugtt

SEQ ID NO: 12037 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaugagaaagcuagaccatt

SEQ ID NO: 12038 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggucuagcuuucucaugatt

SEQ ID NO: 12039 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugagaaagcuagaccactt

SEQ ID NO: 12040 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggucuagcuuucucaugtt

SEQ ID NO: 12041 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augagaaagcuagaccacutt

SEQ ID NO: 12042 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggucuagcuuucucautt

SEQ ID NO: 12043 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugcgguauuucuucuactt

SEQ ID NO: 12044 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaagaaauaccgcagutt

SEQ ID NO: 12045 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuucuucuacucgaguggtt

SEQ ID NO: 12046 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacucgaguagaagaaautt

SEQ ID NO: 12047 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuucuacucgaguggugatt

SEQ ID NO: 12048 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaccacucgaguagaagatt

SEQ ID NO: 12049 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaguggugagaagaaagatt

SEQ ID NO: 12050 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuucuucucaccacucgtt

SEQ ID NO: 12051 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaagaugaggucuaccutt

SEQ ID NO: 12052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguagaccucaucuuucutt

SEQ ID NO: 12053 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaagaugaggucuaccuutt

SEQ ID NO: 12054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguagaccucaucuuuctt

SEQ ID NO: 12055 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggucuaccuuaaccuggtt

SEQ ID NO: 12056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagguuaagguagaccuctt

SEQ ID NO: 12057 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaccuuaaccuggugcugtt

SEQ ID NO: 12058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcaccagguuaagguagtt

SEQ ID NO: 12059 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuggugcuggacuaugutt

SEQ ID NO: 12060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauaguccagcaccaggutt

SEQ ID NO: 12061 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggugcuggacuauguutt

SEQ ID NO: 12062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacauaguccagcaccaggtt

SEQ ID NO: 12063 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugcuggacuauguuccgtt

SEQ ID NO: 12064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaacauaguccagcacctt

SEQ ID NO: 12065 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccggagacaguguacagtt

SEQ ID NO: 12066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguacacugucuccggaatt

SEQ ID NO: 12067 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagacaguguacagaguctt

SEQ ID NO: 12068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacucuguacacugucucctt

SEQ ID NO: 12069 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacaguguacagagucgctt

SEQ ID NO: 12070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgacucuguacacugucutt

SEQ ID NO: 12071 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguacagagucgccagacatt

SEQ ID NO: 12072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucuggcgacucuguacatt

SEQ ID NO: 12073 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagagucgccagacacuatt

SEQ ID NO: 12074 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagugucuggcgacucugutt

SEQ ID NO: 12075 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagucgccagacacuautt

SEQ ID NO: 12076 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagugucuggcgacucugtt

SEQ ID NO: 12077 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucgagccaagcagacacutt

SEQ ID NO: 12078 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugucugcuuggcucgactt

SEQ ID NO: 12079 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgagccaagcagacacuctt

SEQ ID NO: 12080 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagugucugcuuggcucgatt

SEQ ID NO: 12081 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagccaagcagacacucctt

SEQ ID NO: 12082 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagugucugcuuggcucgtt

SEQ ID NO: 12083 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaagcagacacucccugtt

SEQ ID NO: 12084 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggagugucugcuuggctt

SEQ ID NO: 12085 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaagcagacacucccugutt

SEQ ID NO: 12086 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagggagugucugcuuggtt

SEQ ID NO: 12087 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagacacucccugugautt

SEQ ID NO: 12088 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucacagggagugucugcutt

SEQ ID NO: 12089 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagacacucccugugauctt

SEQ ID NO: 12090 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucacagggagugucugctt

SEQ ID NO: 12091 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugaucuaugucaaguutt

SEQ ID NO: 12092 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuugacauagaucacagtt

SEQ ID NO: 12093 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaugucaaguuguauaugtt

SEQ ID NO: 12094 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauauacaacuugacauagtt

SEQ ID NO: 12095 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augucaaguuguauauguatt

SEQ ID NO: 12096 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacauauacaacuugacautt

SEQ ID NO: 12097 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucaaguuguauauguautt

SEQ ID NO: 12098 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacauauacaacuugacatt

SEQ ID NO: 12099 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaguuguauauguaucagtt

SEQ ID NO: 12100 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugauacauauacaacuugtt

SEQ ID NO: 12101 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguaucagcuguucagaatt

SEQ ID NO: 12102 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucugaacagcugauacautt

SEQ ID NO: 12103 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaucagcuguucagaagtt

SEQ ID NO: 12104 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucugaacagcugauacatt

SEQ ID NO: 12105 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuguucagaagucuagctt

SEQ ID NO: 12106 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuagacuucugaacagcutt

SEQ ID NO: 12107 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauauccauuccuuuggatt

SEQ ID NO: 12108 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaaggaauggauauagtt

SEQ ID NO: 12109 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauauccauuccuuuggaatt

SEQ ID NO: 12110 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaaaggaauggauauatt

SEQ ID NO: 12111 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuggaaucugccaucgtt

SEQ ID NO: 12112 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgauggcagauuccaaaggtt

SEQ ID NO: 12113 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggaaucugccaucgagatt

SEQ ID NO: 12114 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucgauggcagauuccaatt

SEQ ID NO: 12115 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaucugccaucgagacatt

SEQ ID NO: 12116 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucucgauggcagauucctt

SEQ ID NO: 12117 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuaaaccacagaaccuctt

SEQ ID NO: 12118 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagguucugugguuuaaugtt

SEQ ID NO: 12119 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaccacagaaccucuutt

SEQ ID NO: 12120 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagagguucugugguuuaatt

SEQ ID NO: 12121 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaccacagaaccucuugtt

SEQ ID NO: 12122 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagagguucugugguuuatt

SEQ ID NO: 12123 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccacagaaccucuuguutt

SEQ ID NO: 12124 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaagagguucugugguutt

SEQ ID NO: 12125 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacagaaccucuuguuggtt

SEQ ID NO: 12126 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaacaagagguucuguggtt

SEQ ID NO: 12127 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagaaccucuuguuggatt

SEQ ID NO: 12128 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaacaagagguucugugtt

SEQ ID NO: 12129 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaaccucuuguuggauctt

SEQ ID NO: 12130 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauccaacaagagguucugtt

SEQ ID NO: 12131 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuuguuggauccugauatt

SEQ ID NO: 12132 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucaggauccaacaagagtt

SEQ ID NO: 12133 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguuggauccugauacatt

SEQ ID NO: 12134 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaucaggauccaacaagtt

SEQ ID NO: 12135 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccugauacagcuguauuatt

SEQ ID NO: 12136 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauacagcuguaucaggatt

SEQ ID NO: 12137 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagcuguauuaaaacucutt

SEQ ID NO: 12138 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaguuuuaauacagcugutt

SEQ ID NO: 12139 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuguauuaaaacucugtt

SEQ ID NO: 12140 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaguuuuaauacagcugtt

SEQ ID NO: 12141 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguauuaaaacucugugtt

SEQ ID NO: 12142 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagaguuuuaauacagctt

SEQ ID NO: 12143 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguauuaaaacucugugatt

SEQ ID NO: 12144 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucacagaguuuuaauacagtt

SEQ ID NO: 12145 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauuaaaacucugugacutt

SEQ ID NO: 12146 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucacagaguuuuaauactt

SEQ ID NO: 12147 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacucugugacuuuggaagtt

SEQ ID NO: 12148 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccaaagucacagaguutt

SEQ ID NO: 12149 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugacuuuggaagugcaatt

SEQ ID NO: 12150 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcacuuccaaagucacatt

SEQ ID NO: 12151 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuuggaagugcaaagcatt

SEQ ID NO: 12152 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuuugcacuuccaaagutt

SEQ ID NO: 12153 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcaaagcagcuggucctt

SEQ ID NO: 12154 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccagcugcuuugcacutt

SEQ ID NO: 12155 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaaagcagcugguccgatt

SEQ ID NO: 12156 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggaccagcugcuuugcatt

SEQ ID NO: 12157 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagcagcugguccgaggtt

SEQ ID NO: 12158 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucggaccagcugcuuugtt

SEQ ID NO: 12159 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcagcugguccgaggagatt

SEQ ID NO: 12160 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccucggaccagcugcutt

SEQ ID NO: 12161 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagcugguccgaggagagtt

SEQ ID NO: 12162 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuccucggaccagcugctt

SEQ ID NO: 12163 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcugguccgaggagagctt

SEQ ID NO: 12164 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucuccucggaccagcugtt

SEQ ID NO: 12165 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugguccgaggagagcctt

SEQ ID NO: 12166 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcucuccucggaccagcutt

SEQ ID NO: 12167 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccgaggagagcccaautt

SEQ ID NO: 12168 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugggcucuccucggacctt

SEQ ID NO: 12169 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccgaggagagcccaaugtt

SEQ ID NO: 12170 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauugggcucuccucggactt

SEQ ID NO: 12171 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaauguuucauauaucugtt

SEQ ID NO: 12172 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauauaugaaacauuggtt

SEQ ID NO: 12173 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagggcaccagaguugatt

SEQ ID NO: 12174 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaacucuggugcccuguatt

SEQ ID NO: 12175 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagggcaccagaguugauctt

SEQ ID NO: 12176 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucaacucuggugcccugtt

SEQ ID NO: 12177 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaccagaguugaucuuutt

SEQ ID NO: 12178 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagaucaacucuggugcctt

SEQ ID NO: 12179 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaccagaguugaucuuugtt

SEQ ID NO: 12180 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagaucaacucuggugctt

SEQ ID NO: 12181 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccagaguugaucuuuggtt

SEQ ID NO: 12182 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaagaucaacucuggugtt

SEQ ID NO: 12183 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguugaucuuuggagccatt

SEQ ID NO: 12184 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuccaaagaucaacuctt

SEQ ID NO: 12185 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggagccacugauuacactt

SEQ ID NO: 12186 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguaaucaguggcuccaatt

SEQ ID NO: 12187 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguauagauguauggucugtt

SEQ ID NO: 12188 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaccauacaucuauacutt

SEQ ID NO: 12189 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagauguauggucugcaggtt

SEQ ID NO: 12190 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugcagaccauacaucuatt

SEQ ID NO: 12191 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauguauggucugcaggcutt

SEQ ID NO: 12192 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccugcagaccauacauctt

SEQ ID NO: 12193 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguauggucugcaggcugtt

SEQ ID NO: 12194 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccugcagaccauacautt

SEQ ID NO: 12195 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauggucugcaggcugutt

SEQ ID NO: 12196 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagccugcagaccauacatt

SEQ ID NO: 12197 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcaggcuguguguuggtt

SEQ ID NO: 12198 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaacacacagccugcagatt

SEQ ID NO: 12199 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuguguguuggcugaautt

SEQ ID NO: 12200 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucagccaacacacagcctt

SEQ ID NO: 12201 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuguguguuggcugaauutt

SEQ ID NO: 12202 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucagccaacacacagctt

SEQ ID NO: 12203 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguguguuggcugaauugtt

SEQ ID NO: 12204 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauucagccaacacacagtt

SEQ ID NO: 12205 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguguuggcugaauuguutt

SEQ ID NO: 12206 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaauucagccaacacactt

SEQ ID NO: 12207 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguguuggcugaauuguugtt

SEQ ID NO: 12208 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacaauucagccaacacatt

SEQ ID NO: 12209 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuguugcuaggacaacctt

SEQ ID NO: 12210 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuguccuagcaacaauutt

SEQ ID NO: 12211 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggacaaccaauauuucctt

SEQ ID NO: 12212 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaauauugguuguccuatt

SEQ ID NO: 12213 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaccaauauuuccugggtt

SEQ ID NO: 12214 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaggaaauauugguugutt

SEQ ID NO: 12215 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaauauuuccuggggactt

SEQ ID NO: 12216 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccccaggaaauauuggutt

SEQ ID NO: 12217 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaauauuuccuggggacatt

SEQ ID NO: 12218 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccccaggaaauauuggtt

SEQ ID NO: 12219 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauauuuccuggggacagtt

SEQ ID NO: 12220 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguccccaggaaauauugtt

SEQ ID NO: 12221 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauauuuccuggggacagutt

SEQ ID NO: 12222 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguccccaggaaauauutt

SEQ ID NO: 12223 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuuccuggggacaguggtt

SEQ ID NO: 12224 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuguccccaggaaauatt

SEQ ID NO: 12225 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggggacagugguguggautt

SEQ ID NO: 12226 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccacaccacuguccccatt

SEQ ID NO: 12227 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacagugguguggaucagutt

SEQ ID NO: 12228 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugauccacaccacuguctt

SEQ ID NO: 12229 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguggaucaguugguggatt

SEQ ID NO: 12230 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaccaacugauccacactt

SEQ ID NO: 12231 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaguugguggaaauaautt

SEQ ID NO: 12232 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuauuuccaccaacugautt

SEQ ID NO: 12233 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggaaauaauaaaggucctt

SEQ ID NO: 12234 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaccuuuauuauuuccactt

SEQ ID NO: 12235 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaauaauaaagguccuagtt

SEQ ID NO: 12236 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaggaccuuuauuauuuctt

SEQ ID NO: 12237 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaaagguccuaggaacactt

SEQ ID NO: 12238 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguuccuaggaccuuuautt

SEQ ID NO: 12239 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagguccuaggaacaccatt

SEQ ID NO: 12240 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguguuccuaggaccuuutt

SEQ ID NO: 12241 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaggaacaccaacaaggtt

SEQ ID NO: 12242 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuguugguguuccuaggtt

SEQ ID NO: 12243 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacaccaacaagggagctt

SEQ ID NO: 12244 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcucccuuguugguguucctt

SEQ ID NO: 12245 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagggagcaaauuagagaatt

SEQ ID NO: 12246 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucuaauuugcucccuutt

SEQ ID NO: 12247 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagcaaauuagagaaautt

SEQ ID NO: 12248 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuucucuaauuugcuccctt

SEQ ID NO: 12249 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauuagagaaaugaaccctt

SEQ ID NO: 12250 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguucauuucucuaauuutt

SEQ ID NO: 12251 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuagagaaaugaacccatt

SEQ ID NO: 12252 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggguucauuucucuaauutt

SEQ ID NO: 12253 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagagaaaugaacccaaautt

SEQ ID NO: 12254 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuggguucauuucucuatt

SEQ ID NO: 12255 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagaaaugaacccaaauutt

SEQ ID NO: 12256 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuuggguucauuucucutt

SEQ ID NO: 12257 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaugaacccaaauuautt

SEQ ID NO: 12258 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaauuuggguucauuucutt

SEQ ID NO: 12259 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaugaacccaaauuauatt

SEQ ID NO: 12260 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaauuuggguucauuuctt

SEQ ID NO: 12261 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugaacccaaauuauacatt

SEQ ID NO: 12262 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguauaauuuggguucauutt

SEQ ID NO: 12263 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaacccaaauuauacagtt

SEQ ID NO: 12264 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguauaauuuggguucautt

SEQ ID NO: 12265 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaauuauacagaauucatt

SEQ ID NO: 12266 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaauucuguauaauuuggtt

SEQ ID NO: 12267 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuauacagaauucaaauuctt

SEQ ID NO: 12268 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaauuugaauucuguauaatt

SEQ ID NO: 12269 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauacagaauucaaauucctt

SEQ ID NO: 12270 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaauuugaauucuguauatt

SEQ ID NO: 12271 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacagaauucaaauuccctt

SEQ ID NO: 12272 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggaauuugaauucuguautt

SEQ ID NO: 12273 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucaaauucccucaaaucatt

SEQ ID NO: 12274 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauuugagggaauuugaatt

SEQ ID NO: 12275 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauucccucaaaucaagtt

SEQ ID NO: 12276 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugauuugagggaauuugtt

SEQ ID NO: 12277 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauucccucaaaucaaggtt

SEQ ID NO: 12278 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugauuugagggaauuutt

SEQ ID NO: 12279 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaaaucaaggcacaucctt

SEQ ID NO: 12280 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaugugccuugauuugagtt

SEQ ID NO: 12281 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaaaucaaggcacauccutt

SEQ ID NO: 12282 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaugugccuugauuugatt

SEQ ID NO: 12283 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucaaggcacauccuuggtt

SEQ ID NO: 12284 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaggaugugccuugauutt

SEQ ID NO: 12285 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaaggcacauccuuggatt

SEQ ID NO: 12286 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaggaugugccuugautt

SEQ ID NO: 12287 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaggcacauccuuggacatt

SEQ ID NO: 12288 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguccaaggaugugccuugtt

SEQ ID NO: 12289 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcacauccuuggacaaatt

SEQ ID NO: 12290 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuguccaaggaugugccutt

SEQ ID NO: 12291 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcacauccuuggacaaagtt

SEQ ID NO: 12292 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuguccaaggaugugcctt

SEQ ID NO: 12293 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacauccuuggacaaaggtt

SEQ ID NO: 12294 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuguccaaggaugugctt

SEQ ID NO: 12295 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacauccuuggacaaaggutt

SEQ ID NO: 12296 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuuguccaaggaugugtt

SEQ ID NO: 12297 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauccuuggacaaaggucutt

SEQ ID NO: 12298 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaccuuuguccaaggaugtt

SEQ ID NO: 12299 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuggacaaaggucuuctt

SEQ ID NO: 12300 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaccuuuguccaaggatt

SEQ ID NO: 12301 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggacaaaggucuuccggctt

SEQ ID NO: 12302 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccggaagaccuuuguccatt

SEQ ID NO: 12303 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaggucuuccggccccgtt

SEQ ID NO: 12304 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggggccggaagaccuuugtt

SEQ ID NO: 12305 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggccccgaacuccacctt

SEQ ID NO: 12306 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggaguucggggccggatt

SEQ ID NO: 12307 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccccgaacuccaccagagtt

SEQ ID NO: 12308 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugguggaguucggggctt

SEQ ID NO: 12309 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccccgaacuccaccagaggtt

SEQ ID NO: 12310 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucugguggaguucggggtt

SEQ ID NO: 12311 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaacuccaccagaggcatt

SEQ ID NO: 12312 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccucugguggaguucggtt

SEQ ID NO: 12313 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgaacuccaccagaggcaatt

SEQ ID NO: 12314 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugccucugguggaguucgtt

SEQ ID NO: 12315 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuccaccagaggcaautt

SEQ ID NO: 12316 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugccucugguggaguuctt

SEQ ID NO: 12317 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaggcaauugcacugugctt

SEQ ID NO: 12318 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacagugcaauugccucutt

SEQ ID NO: 12319 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaggcaauugcacugugcatt

SEQ ID NO: 12320 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacagugcaauugccuctt

SEQ ID NO: 12321 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaauugcacugugcagctt

SEQ ID NO: 12322 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcacagugcaauugcctt

SEQ ID NO: 12323 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaauugcacugugcagcctt

SEQ ID NO: 12324 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugcacagugcaauugctt

SEQ ID NO: 12325 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauugcacugugcagccgutt

SEQ ID NO: 12326 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acggcugcacagugcaauutt

SEQ ID NO: 12327 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auugcacugugcagccguctt

SEQ ID NO: 12328 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacggcugcacagugcaautt

SEQ ID NO: 12329 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugcagccgucugcuggtt

SEQ ID NO: 12330 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcagacggcugcacagtt

SEQ ID NO: 12331 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuggaguacacaccuacctt

SEQ ID NO: 12332 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagguguguacuccagctt

SEQ ID NO: 12333 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcuaacaccacuggaagtt

SEQ ID NO: 12334 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuccagugguguuagccgtt

SEQ ID NO: 12335 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaacaccacuggaagcutt

SEQ ID NO: 12336 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuuccagugguguuagctt

SEQ ID NO: 12337 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuaacaccacuggaagcuutt

SEQ ID NO: 12338 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuuccagugguguuagtt

SEQ ID NO: 12339 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaccacuggaagcuugutt

SEQ ID NO: 12340 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaagcuuccagugguguutt

SEQ ID NO: 12341 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccacuggaagcuugugtt

SEQ ID NO: 12342 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaagcuuccaguggugutt

SEQ ID NO: 12343 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccacuggaagcuugugctt

SEQ ID NO: 12344 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacaagcuuccaguggugtt

SEQ ID NO: 12345 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuggaagcuugugcatt

SEQ ID NO: 12346 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacaagcuuccaguggutt

SEQ ID NO: 12347 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuggaagcuugugcacatt

SEQ ID NO: 12348 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugcacaagcuuccagugtt

SEQ ID NO: 12349 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggaagcuugugcacauutt

SEQ ID NO: 12350 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugugcacaagcuuccagtt

SEQ ID NO: 12351 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaagcuugugcacauuctt

SEQ ID NO: 12352 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaugugcacaagcuuccatt

SEQ ID NO: 12353 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagcuugugcacauucatt

SEQ ID NO: 12354 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaugugcacaagcuucctt

SEQ ID NO: 12355 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagcuugugcacauucautt

SEQ ID NO: 12356 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaaugugcacaagcuuctt

SEQ ID NO: 12357 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcuugugcacauucauuutt

SEQ ID NO: 12358 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaugaaugugcacaagcutt

SEQ ID NO: 12359 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcugcaagccagugcatt

SEQ ID NO: 12360 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacuggcuugcagcucutt

SEQ ID NO: 12361 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcugcaagccagugcagtt

SEQ ID NO: 12362 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcacuggcuugcagcuctt

SEQ ID NO: 12363 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagcagccuucagcuuutt

SEQ ID NO: 12364 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcugaaggcugcugcatt

SEQ ID NO: 12365 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagagauaaagauggcagtt

SEQ ID NO: 12366 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugccaucuuuaucucugctt

SEQ ID NO: 12367 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggguccugacaggccactt

SEQ ID NO: 12368 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggccugucaggacccugtt

SEQ ID NO: 12369 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaaaguucuacaggacaatt

SEQ ID NO: 12370 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccuguagaacuuucutt

SEQ ID NO: 12371 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuggacuauguuccggatt

SEQ ID NO: 12372 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccggaacauaguccagcatt

SEQ ID NO: 12373 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucagcuguucagaaguctt

SEQ ID NO: 12374 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuucugaacagcugauatt

SEQ ID NO: 12375 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauuccuuuggaaucugcctt

SEQ ID NO: 12376 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcagauuccaaaggaaugtt

SEQ ID NO: 12377 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucugccaucgagacauutt

SEQ ID NO: 12378 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugucucgauggcagauutt

SEQ ID NO: 12379 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacauuaaaccacagaacctt

SEQ ID NO: 12380 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucugugguuuaauguctt

SEQ ID NO: 12381 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgaggagagcccaauguutt

SEQ ID NO: 12382 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacauugggcucuccucggtt

SEQ ID NO: 12383 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucugcaggcuguguguugtt

SEQ ID NO: 12384 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacacacagccugcagactt

SEQ ID NO: 12385 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacagugguguggaucagtt

SEQ ID NO: 12386 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugauccacaccacugucctt

SEQ ID NO: 12387 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaauaaagguccuaggaatt

SEQ ID NO: 12388 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuaggaccuuuauuautt

SEQ ID NO: 12389 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaauuagagaaaugaactt

SEQ ID NO: 12390 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucauuucucuaauuugctt

SEQ ID NO: 12391 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuagagaaaugaacccaatt

SEQ ID NO: 12392 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggguucauuucucuaautt

SEQ ID NO: 12393 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacccaaauuauacagaautt

SEQ ID NO: 12394 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucuguauaauuuggguutt

SEQ ID NO: 12395 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggucuuccggccccgaatt

SEQ ID NO: 12396 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucggggccggaagaccuutt

SEQ ID NO: 12397 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggccccgaacuccaccagtt

SEQ ID NO: 12398 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguggaguucggggccgtt

SEQ ID NO: 12399 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaggcaauugcacugutt

SEQ ID NO: 12400 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagugcaauugccucuggtt

SEQ ID NO: 12401 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugcagccgucugcuggatt

SEQ ID NO: 12402 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagcagacggcugcacatt

SEQ ID NO: 12403 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgagaaccaccuccuuugtt

SEQ ID NO: 12404 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaggaggugguucucggtt

SEQ ID NO: 12405 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagaaccaccuccuuugctt

SEQ ID NO: 12406 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaaaggaggugguucucgtt

SEQ ID NO: 12407 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuccuuugcggagagcutt

SEQ ID NO: 12408 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcucuccgcaaaggaggutt

SEQ ID NO: 12409 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuugcggagagcugcaatt

SEQ ID NO: 12410 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcagcucuccgcaaaggtt

SEQ ID NO: 12411 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggagagcugcaagccagugtt

SEQ ID NO: 12412 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuggcuugcagcucucctt

SEQ ID NO: 12413 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agugcagcagccuucagcutt

SEQ ID NO: 12414 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugaaggcugcugcacutt

SEQ ID NO: 12415 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcagcagccuucagcuutt

SEQ ID NO: 12416 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcugaaggcugcugcactt

SEQ ID NO: 12417 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuucagcuuuugguagcautt

SEQ ID NO: 12418 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augcuaccaaaagcugaagtt

SEQ ID NO: 12419 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguagcaugaaaguuagctt

SEQ ID NO: 12420 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuaacuuucaugcuaccatt

SEQ ID NO: 12421 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaugaaaguuagcagagatt

SEQ ID NO: 12422 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucugcuaacuuucaugctt

SEQ ID NO: 12423 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caugaaaguuagcagagautt

SEQ ID NO: 12424 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucucugcuaacuuucaugtt

SEQ ID NO: 12425 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagauaaagauggcagcatt

SEQ ID NO: 12426 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcugccaucuuuaucucutt

SEQ ID NO: 12427 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagauaaagauggcagcaatt

SEQ ID NO: 12428 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcugccaucuuuaucuctt

SEQ ID NO: 12429 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagguaaccacaguagugtt

SEQ ID NO: 12430 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuacugugguuaccuugtt

SEQ ID NO: 12431 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caacuccuggccagggucctt

SEQ ID NO: 12432 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacccuggccaggaguugtt

SEQ ID NO: 12433 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccuggccaggguccugtt

SEQ ID NO: 12434 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggacccuggccaggagutt

SEQ ID NO: 12435 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccuggccaggguccugatt

SEQ ID NO: 12436 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaggacccuggccaggagtt

SEQ ID NO: 12437 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuggccaggguccugactt

SEQ ID NO: 12438 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaggacccuggccaggatt

SEQ ID NO: 12439 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccugacaggccacaggatt

SEQ ID NO: 12440 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuguggccugucaggactt

SEQ ID NO: 12441 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggccacaggaagucaguutt

SEQ ID NO: 12442 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugacuuccuguggccutt

SEQ ID NO: 12443 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuauacagacacgaaagtt

SEQ ID NO: 12444 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucgugucuguauaacutt

SEQ ID NO: 12445 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaacuuugugauucuggtt

SEQ ID NO: 12446 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagaaucacaaaguuuggtt

SEQ ID NO: 12447 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaacuuugugauucuggatt

SEQ ID NO: 12448 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagaaucacaaaguuugtt

SEQ ID NO: 12449 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacuuugugauucuggagtt

SEQ ID NO: 12450 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccagaaucacaaaguuutt

SEQ ID NO: 12451 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuuugugauucuggagatt

SEQ ID NO: 12452 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccagaaucacaaaguutt

SEQ ID NO: 12453 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaguucuacaggacaagtt

SEQ ID NO: 12454 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuguccuguagaacuuuctt

SEQ ID NO: 12455 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaguucuacaggacaagctt

SEQ ID NO: 12456 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuguccuguagaacuuutt

SEQ ID NO: 12457 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguucuacaggacaagcgtt

SEQ ID NO: 12458 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcuuguccuguagaacuutt

SEQ ID NO: 12459 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgagagcuccagaucautt

SEQ ID NO: 12460 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augaucuggagcucucggutt

SEQ ID NO: 12461 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggugagaagaaagaugtt

SEQ ID NO: 12462 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuuucuucucaccacutt

SEQ ID NO: 12463 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagaagaaagaugagguctt

SEQ ID NO: 12464 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccucaucuuucuucucatt

SEQ ID NO: 12465 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaagaugaggucuacctt

SEQ ID NO: 12466 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagaccucaucuuucuutt

SEQ ID NO: 12467 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuccuuuggaaucugccatt

SEQ ID NO: 12468 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcagauuccaaaggaautt

SEQ ID NO: 12469 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaaucugccaucgagactt

SEQ ID NO: 12470 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucucgauggcagauuccatt

SEQ ID NO: 12471 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggauccugauacagcuguatt

SEQ ID NO: 12472 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagcuguaucaggaucctt

SEQ ID NO: 12473 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucugugacuuuggaagutt

SEQ ID NO: 12474 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuccaaagucacagagutt

SEQ ID NO: 12475 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugguccgaggagagccctt

SEQ ID NO: 12476 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggcucuccucggaccagctt

SEQ ID NO: 12477 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccaauguuucauauaucutt

SEQ ID NO: 12478 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauauaugaaacauugggtt

SEQ ID NO: 12479 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auguuucauauaucuguuctt

SEQ ID NO: 12480 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacagauauaugaaacautt

SEQ ID NO: 12481 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuuuggagccacugauutt

SEQ ID NO: 12482 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaucaguggcuccaaagautt

SEQ ID NO: 12483 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucugcaggcuguguguutt

SEQ ID NO: 12484 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacacacagccugcagacctt

SEQ ID NO: 12485 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaggcuguguguuggcutt

SEQ ID NO: 12486 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccaacacacagccugcatt

SEQ ID NO: 12487 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguuggcugaauuguugctt

SEQ ID NO: 12488 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaacaauucagccaacactt

SEQ ID NO: 12489 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggggacagugguguggatt

SEQ ID NO: 12490 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccacaccacuguccccagtt

SEQ ID NO: 12491 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggacagugguguggauctt

SEQ ID NO: 12492 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauccacaccacugucccctt

SEQ ID NO: 12493 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggacagugguguggaucatt

SEQ ID NO: 12494 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauccacaccacuguccctt

SEQ ID NO: 12495 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguugguggaaauaauaaatt

SEQ ID NO: 12496 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuauuauuuccaccaacutt

SEQ ID NO: 12497 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguggaaauaauaaagguctt

SEQ ID NO: 12498 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccuuuauuauuuccacctt

SEQ ID NO: 12499 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaaauaauaaagguccutt

SEQ ID NO: 12500 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaccuuuauuauuuccatt

SEQ ID NO: 12501 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauuagagaaaugaacctt

SEQ ID NO: 12502 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguucauuucucuaauuugtt

SEQ ID NO: 12503 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacccaaauuauacagatt

SEQ ID NO: 12504 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuguauaauuuggguucatt

SEQ ID NO: 12505 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacccaaauuauacagaatt

SEQ ID NO: 12506 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuguauaauuuggguuctt

SEQ ID NO: 12507 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauuauacagaauucaaatt

SEQ ID NO: 12508 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugaauucuguauaauuutt

SEQ ID NO: 12509 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaauucaaauucccucatt

SEQ ID NO: 12510 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugagggaauuugaauucugtt

SEQ ID NO: 12511 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauucaaauucccucaaautt

SEQ ID NO: 12512 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugagggaauuugaauutt

SEQ ID NO: 12513 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuccggccccgaacucctt

SEQ ID NO: 12514 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguucggggccggaagatt

SEQ ID NO: 12515 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccccgaacuccaccagatt

SEQ ID NO: 12516 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugguggaguucggggcctt

SEQ ID NO: 12517 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuccaccagaggcaauutt

SEQ ID NO: 12518 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauugccucugguggaguutt

SEQ ID NO: 12519 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccaccagaggcaauugtt

SEQ ID NO: 12520 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauugccucugguggagutt

SEQ ID NO: 12521 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagaggcaauugcacugugtt

SEQ ID NO: 12522 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagugcaauugccucugtt

SEQ ID NO: 12523 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugugcagccgucugcugtt

SEQ ID NO: 12524 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcagacggcugcacagutt

SEQ ID NO: 12525 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcagccgucugcuggagtt

SEQ ID NO: 12526 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccagcagacggcugcactt

SEQ ID NO: 12527 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagccgucugcuggaguatt

SEQ ID NO: 12528 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuccagcagacggcugctt

SEQ ID NO: 12529 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagagauaaagauggcagctt

SEQ ID NO: 12530 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugccaucuuuaucucugtt

SEQ ID NO: 12531 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaagaaccgagagcuccagtt

SEQ ID NO: 12532 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggagcucucgguucuuatt

SEQ ID NO: 12533 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagaaccgagagcuccagatt

SEQ ID NO: 12534 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuggagcucucgguucuutt

SEQ ID NO: 12535 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagaaagaugaggucuactt

SEQ ID NO: 12536 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaccucaucuuucuuctt

SEQ ID NO: 12537 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuucauauaucuguucuctt

SEQ ID NO: 12538 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaacagauauaugaaactt

SEQ ID NO: 12539 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauaaagguccuaggaacatt

SEQ ID NO: 12540 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguuccuaggaccuuuauutt

SEQ ID NO: 12541 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggaagcuugugcacautt

SEQ ID NO: 12542 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
augugcacaagcuuccagutt

SEQ ID NO: 12543 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcaagccagugcagcagctt

SEQ ID NO: 12544 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcugcacuggcuugcatt

SEQ ID NO: 12545 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccagugcagcagccuuctt

SEQ ID NO: 12546 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaggcugcugcacuggcutt

SEQ ID NO: 12547 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagguaaccacaguaguggtt

SEQ ID NO: 12548 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacuacugugguuaccuutt

SEQ ID NO: 12549 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaggguccugacaggcctt

SEQ ID NO: 12550 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggccugucaggacccuggctt

SEQ ID NO: 12551 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaaauggaucauuuggutt

SEQ ID NO: 12552 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaaaugauccauuuccatt

SEQ ID NO: 12553 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuggagaacugguugcctt

SEQ ID NO: 12554 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcaaccaguucuccagaatt

SEQ ID NO: 12555 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaacugguugccaucaatt

SEQ ID NO: 12556 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugauggcaaccaguucuctt

SEQ ID NO: 12557 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaacugguugccaucaagtt

SEQ ID NO: 12558 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugauggcaaccaguucutt

SEQ ID NO: 12559 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucaaguuguauauguauctt

SEQ ID NO: 12560 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauacauauacaacuugactt

SEQ ID NO: 12561 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccauuccuuuggaaucugtt

SEQ ID NO: 12562 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagauuccaaaggaauggatt

SEQ ID NO: 12563 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugcaaagcagcugguccgtt

SEQ ID NO: 12564 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggaccagcugcuuugcactt

SEQ ID NO: 12565 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuacagggcaccagagutt

SEQ ID NO: 12566 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucuggugcccuguaguatt

SEQ ID NO: 12567 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcaggcuguguguuggctt

SEQ ID NO: 12568 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaacacacagccugcagtt

SEQ ID NO: 12569 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcacugugcagccgucutt

SEQ ID NO: 12570 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacggcugcacagugcaatt

SEQ ID NO: 12571 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagcuugugcacauucauutt

SEQ ID NO: 12572 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaugaaugugcacaagcuutt

SEQ ID NO: 12573 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuccuuugcggagagcugtt

SEQ ID NO: 12574 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcucuccgcaaaggaggtt

SEQ ID NO: 12575 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaagccagugcagcagcctt

SEQ ID NO: 12576 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugcugcacuggcuugctt

SEQ ID NO: 12577 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuggccaggguccugacagtt

SEQ ID NO: 12578 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugucaggacccuggccagtt

SEQ ID NO: 12579 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacugguugccaucaagatt

SEQ ID NO: 12580 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuugauggcaaccaguuctt

SEQ ID NO: 12581 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guacuacagggcaccagagtt

SEQ ID NO: 12582 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuggugcccuguaguactt

SEQ ID NO: 12583 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagccacugauuacacgtt

SEQ ID NO: 12584 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cguguaaucaguggcuccatt

SEQ ID NO: 12585 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcugaauuguugcuaggtt

SEQ ID NO: 12586 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuagcaacaauucagccatt

SEQ ID NO: 12587 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaauaauaaagguccuatt

SEQ ID NO: 12588 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaggaccuuuauuauuucctt

SEQ ID NO: 12589 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggacaaaggucuuccggtt

SEQ ID NO: 12590 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccggaagaccuuuguccaatt

SEQ ID NO: 12591 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auagucgagccaagcagactt

SEQ ID NO: 12592 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucugcuuggcucgacuautt

SEQ ID NO: 12593 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaagaaccgagagcuccatt

SEQ ID NO: 12594 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggagcucucgguucuuaatt

SEQ ID NO: 12595 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccgagagcuccagaucatt

SEQ ID NO: 12596 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucuggagcucucgguutt

SEQ ID NO: 12597 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaaguuagcagagauaaatt

SEQ ID NO: 12598 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuaucucugcuaacuuuctt

SEQ ID NO: 12599 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaguaguggcaacuccugtt

SEQ ID NO: 12600 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaguugccacuacugutt

SEQ ID NO: 12601 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaucauuuggugugguautt

SEQ ID NO: 12602 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaccacaccaaaugaucctt

SEQ ID NO: 12603 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaccgagagcuccagauctt

SEQ ID NO: 12604 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucuggagcucucgguuctt

SEQ ID NO: 12605 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccuuaaccuggugcuggtt

SEQ ID NO: 12606 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcaccagguuaagguatt

SEQ ID NO: 12607 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuaaccuggugcuggatt

SEQ ID NO: 12608 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccagcaccagguuaaggutt

SEQ ID NO: 12609 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuaaccuggugcuggactt

SEQ ID NO: 12610 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccagcaccagguuaaggtt

SEQ ID NO: 12611 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcuguucagaagucuagtt

SEQ ID NO: 12612 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagacuucugaacagcugtt

SEQ ID NO: 12613 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaucgagacauuaaactt

SEQ ID NO: 12614 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuaaugucucgauggcatt

SEQ ID NO: 12615 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuaaaacucugugacuutt

SEQ ID NO: 12616 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagucacagaguuuuaauatt

SEQ ID NO: 12617 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuggaagugcaaagcagctt

SEQ ID NO: 12618 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcuuugcacuuccaaatt

SEQ ID NO: 12619 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaagugcaaagcagcuggtt

SEQ ID NO: 12620 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagcugcuuugcacuucctt

SEQ ID NO: 12621 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggaucaguugguggaaatt

SEQ ID NO: 12622 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuccaccaacugauccactt

SEQ ID NO: 12623 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaucaguugguggaaautt

SEQ ID NO: 12624 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuccaccaacugauccatt

SEQ ID NO: 12625 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacaccaacaagggagcaatt

SEQ ID NO: 12626 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcucccuuguugguguutt

SEQ ID NO: 12627 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaugaacccaaauuauactt

SEQ ID NO: 12628 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guauaauuuggguucauuutt

SEQ ID NO: 12629 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaggucuuccggccccgatt

SEQ ID NO: 12630 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucggggccggaagaccuuutt

SEQ ID NO: 12631 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguaaccacaguaguggctt

SEQ ID NO: 12632 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccacuacugugguuaccutt

SEQ ID NO: 12633 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagccuauauccauuccuutt

SEQ ID NO: 12634 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggaauggauauaggcuatt

SEQ ID NO: 12635 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaguuagcagagauaaagtt

SEQ ID NO: 12636 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuaucucugcuaacuuutt

SEQ ID NO: 12637 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaguuagcagagauaaagatt

SEQ ID NO: 12638 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuuuaucucugcuaacuutt

SEQ ID NO: 12639 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaaccacaguaguggcaatt

SEQ ID NO: 12640 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugccacuacugugguuactt

SEQ ID NO: 12641 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggguccugacaggccacatt

SEQ ID NO: 12642 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguggccugucaggacccutt

SEQ ID NO: 12643 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggguccugacaggccacagtt

SEQ ID NO: 12644 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguggccugucaggaccctt

SEQ ID NO: 12645 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaagugauuggaaauggatt

SEQ ID NO: 12646 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccauuuccaaucacuuuctt

SEQ ID NO: 12647 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaucaagaaaguucuactt

SEQ ID NO: 12648 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagaacuuucuugauggctt

SEQ ID NO: 12649 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaagaaaguucuacaggatt

SEQ ID NO: 12650 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuguagaacuuucuugatt

SEQ ID NO: 12651 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaagcgauuuaagaactt

SEQ ID NO: 12652 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuuaaaucgcuugucctt

SEQ ID NO: 12653 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuaagaaccgagagcuctt

SEQ ID NO: 12654 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcucucgguucuuaaautt

SEQ ID NO: 12655 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagcuccagaucaugagatt

SEQ ID NO: 12656 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucucaugaucuggagcucutt

SEQ ID NO: 12657 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcgguauuucuucuacutt

SEQ ID NO: 12658 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguagaagaaauaccgcagtt

SEQ ID NO: 12659 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcgguauuucuucuacuctt

SEQ ID NO: 12660 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguagaagaaauaccgcatt

SEQ ID NO: 12661 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggucuaccuuaaccuggugtt

SEQ ID NO: 12662 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccagguuaagguagacctt

SEQ ID NO: 12663 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaccuggugcuggacuautt

SEQ ID NO: 12664 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaguccagcaccagguuatt

SEQ ID NO: 12665 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucccugugaucuaugucatt

SEQ ID NO: 12666 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacauagaucacagggagtt

SEQ ID NO: 12667 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuggaagugcaaagcagtt

SEQ ID NO: 12668 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuuugcacuuccaaagtt

SEQ ID NO: 12669 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagcagcugguccgaggatt

SEQ ID NO: 12670 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccucggaccagcugcuuutt

SEQ ID NO: 12671 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcccaauguuucauauatt

SEQ ID NO: 12672 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauaugaaacauugggcuctt

SEQ ID NO: 12673 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuguucucgguacuacatt

SEQ ID NO: 12674 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uguaguaccgagaacagautt

SEQ ID NO: 12675 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggacaaccaauauuuccutt

SEQ ID NO: 12676 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaaauauugguuguccutt

SEQ ID NO: 12677 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacaaccaauauuuccugtt

SEQ ID NO: 12678 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggaaauauugguugucctt

SEQ ID NO: 12679 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguugguggaaauaauatt

SEQ ID NO: 12680 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauuauuuccaccaacugatt

SEQ ID NO: 12681 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacaccaacaagggagcatt

SEQ ID NO: 12682 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcucccuuguugguguuctt

SEQ ID NO: 12683 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auucccucaaaucaaggcatt

SEQ ID NO: 12684 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccuugauuugagggaautt

SEQ ID NO: 12685 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucccucaaaucaaggcactt

SEQ ID NO: 12686 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugccuugauuugagggaatt

SEQ ID NO: 12687 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caauugcacugugcagccgtt

SEQ ID NO: 12688 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggcugcacagugcaauugtt

SEQ ID NO: 12689 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgagaaccaccuccuuutt

SEQ ID NO: 12690 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaggaggugguucucggutt

SEQ ID NO: 12691 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugcggagagcugcaagcctt

SEQ ID NO: 12692 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcuugcagcucuccgcaatt

SEQ ID NO: 12693 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcggagagcugcaagccatt

SEQ ID NO: 12694 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcuugcagcucuccgcatt

SEQ ID NO: 12695 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugcaagccagugcagctt

SEQ ID NO: 12696 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcacuggcuugcagcutt

SEQ ID NO: 12697 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcugcaagccagugcagcatt

SEQ ID NO: 12698 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcugcacuggcuugcagctt

SEQ ID NO: 12699 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagugcagcagccuucatt

SEQ ID NO: 12700 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaggcugcugcacuggctt

SEQ ID NO: 12701 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccagugcagcagccuucagtt

SEQ ID NO: 12702 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugaaggcugcugcacuggtt

SEQ ID NO: 12703 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuuugguagcaugaaagtt

SEQ ID NO: 12704 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucaugcuaccaaaagctt

SEQ ID NO: 12705 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguagcaugaaaguuagcatt

SEQ ID NO: 12706 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuaacuuucaugcuacctt

SEQ ID NO: 12707 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guagcaugaaaguuagcagtt

SEQ ID NO: 12708 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcuaacuuucaugcuactt

SEQ ID NO: 12709 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcaugaaaguuagcagatt

SEQ ID NO: 12710 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcuaacuuucaugcuatt

SEQ ID NO: 12711 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguuagcagagauaaagautt

SEQ ID NO: 12712 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuuuaucucugcuaacutt

SEQ ID NO: 12713 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuagcagagauaaagaugtt

SEQ ID NO: 12714 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucuuuaucucugcuaactt

SEQ ID NO: 12715 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuagcagagauaaagauggtt

SEQ ID NO: 12716 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucuuuaucucugcuaatt

SEQ ID NO: 12717 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauaaagauggcagcaaggtt

SEQ ID NO: 12718 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuugcugccaucuuuauctt

SEQ ID NO: 12719 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaaagauggcagcaaggutt

SEQ ID NO: 12720 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuugcugccaucuuuautt

SEQ ID NO: 12721 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaguaguggcaacucctt

SEQ ID NO: 12722 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaguugccacuacuguggtt

SEQ ID NO: 12723 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcaacuccuggccagggtt

SEQ ID NO: 12724 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuggccaggaguugccatt

SEQ ID NO: 12725 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccaggguccugacaggtt

SEQ ID NO: 12726 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccugucaggacccuggccatt

SEQ ID NO: 12727 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggguccugacaggccatt

SEQ ID NO: 12728 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggccugucaggacccuggtt

SEQ ID NO: 12729 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguccugacaggccacaggtt

SEQ ID NO: 12730 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuguggccugucaggacctt

SEQ ID NO: 12731 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacaggccacaggaagutt

SEQ ID NO: 12732 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuccuguggccugucagtt

SEQ ID NO: 12733 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auacagacacgaaagugautt

SEQ ID NO: 12734 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucacuuucgugucuguautt

SEQ ID NO: 12735 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acagacacgaaagugauugtt

SEQ ID NO: 12736 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaucacuuucgugucugutt

SEQ ID NO: 12737 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggaucauuugguguggutt

SEQ ID NO: 12738 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacaccaaaugauccautt

SEQ ID NO: 12739 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguauaucaagccaaactt

SEQ ID NO: 12740 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuuggcuugauauaccactt

SEQ ID NO: 12741 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugguugccaucaagaatt

SEQ ID NO: 12742 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuugauggcaaccaguutt

SEQ ID NO: 12743 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugguugccaucaagaaatt

SEQ ID NO: 12744 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuucuugauggcaaccagutt

SEQ ID NO: 12745 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguugccaucaagaaagtt

SEQ ID NO: 12746 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuucuugauggcaaccagtt

SEQ ID NO: 12747 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugccaucaagaaaguucuatt

SEQ ID NO: 12748 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagaacuuucuugauggcatt

SEQ ID NO: 12749 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagaaaguucuacaggactt

SEQ ID NO: 12750 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guccuguagaacuuucuugtt

SEQ ID NO: 12751 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagagcuccagaucaugatt

SEQ ID NO: 12752 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaugaucuggagcucucgtt

SEQ ID NO: 12753 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagcuccagaucaugagaatt

SEQ ID NO: 12754 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucucaugaucuggagcuctt

SEQ ID NO: 12755 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuagaccacuguaacauagtt

SEQ ID NO: 12756 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuauguuacaguggucuagtt

SEQ ID NO: 12757 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggugagaagaaagaugatt

SEQ ID NO: 12758 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaucuuucuucucaccactt

SEQ ID NO: 12759 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugagaagaaagaugagtt

SEQ ID NO: 12760 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaucuuucuucucaccatt

SEQ ID NO: 12761 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuaccuuaaccuggugcutt

SEQ ID NO: 12762 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcaccagguuaagguagatt

SEQ ID NO: 12763 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggugcuggacuauguucctt

SEQ ID NO: 12764 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaacauaguccagcaccatt

SEQ ID NO: 12765 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagacaguguacagagutt

SEQ ID NO: 12766 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acucuguacacugucuccgtt

SEQ ID NO: 12767 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagccaagcagacacuccctt

SEQ ID NO: 12768 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gggagugucugcuuggcuctt

SEQ ID NO: 12769 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccaagcagacacucccutt

SEQ ID NO: 12770 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggagugucugcuuggcutt

SEQ ID NO: 12771 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagacacucccugugaucutt

SEQ ID NO: 12772 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agaucacagggagugucugtt

SEQ ID NO: 12773 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuguauauguaucagcugtt

SEQ ID NO: 12774 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcugauacauauacaactt

SEQ ID NO: 12775 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucagcuguucagaagucutt

SEQ ID NO: 12776 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacuucugaacagcugautt

SEQ ID NO: 12777 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucagcuguucagaagucuatt

SEQ ID NO: 12778 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagacuucugaacagcugatt

SEQ ID NO: 12779 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agccuauauccauuccuuutt

SEQ ID NO: 12780 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaggaauggauauaggcutt

SEQ ID NO: 12781 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccuauauccauuccuuugtt

SEQ ID NO: 12782 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaaggaauggauauaggctt

SEQ ID NO: 12783 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuauauccauuccuuuggtt

SEQ ID NO: 12784 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaaggaauggauauaggtt

SEQ ID NO: 12785 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auauccauuccuuuggaautt

SEQ ID NO: 12786 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuccaaaggaauggauautt

SEQ ID NO: 12787 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauccauuccuuuggaauctt

SEQ ID NO: 12788 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauuccaaaggaauggauatt

SEQ ID NO: 12789 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccauuccuuuggaaucugctt

SEQ ID NO: 12790 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcagauuccaaaggaauggtt

SEQ ID NO: 12791 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuuuggaaucugccauctt

SEQ ID NO: 12792 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcagauuccaaaggatt

SEQ ID NO: 12793 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuaaaccacagaaccucutt

SEQ ID NO: 12794 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agagguucugugguuuaautt

SEQ ID NO: 12795 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuaaaacucugugacuuutt

SEQ ID NO: 12796 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaagucacagaguuuuaautt

SEQ ID NO: 12797 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaacucugugacuuugtt

SEQ ID NO: 12798 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaagucacagaguuuuaatt

SEQ ID NO: 12799 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaacucugugacuuuggaatt

SEQ ID NO: 12800 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccaaagucacagaguuutt

SEQ ID NO: 12801 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugacuuuggaagugcaaatt

SEQ ID NO: 12802 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugcacuuccaaagucactt

SEQ ID NO: 12803 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugacuuuggaagugcaaagtt

SEQ ID NO: 12804 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugcacuuccaaagucatt

SEQ ID NO: 12805 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuggaagugcaaagcagcutt

SEQ ID NO: 12806 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agcugcuuugcacuuccaatt

SEQ ID NO: 12807 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggaagugcaaagcagcugtt

SEQ ID NO: 12808 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagcugcuuugcacuuccatt

SEQ ID NO: 12809 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaagugcaaagcagcuggutt

SEQ ID NO: 12810 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accagcugcuuugcacuuctt

SEQ ID NO: 12811 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugguccgaggagagcccatt

SEQ ID NO: 12812 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugggcucuccucggaccagtt

SEQ ID NO: 12813 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguccgaggagagcccaatt

SEQ ID NO: 12814 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugggcucuccucggaccatt

SEQ ID NO: 12815 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggagagcccaauguuucatt

SEQ ID NO: 12816 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaaacauugggcucuccutt

SEQ ID NO: 12817 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaucuguucucgguacuactt

SEQ ID NO: 12818 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guaguaccgagaacagauatt

SEQ ID NO: 12819 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uauggucugcaggcugugutt

SEQ ID NO: 12820 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacagccugcagaccauatt

SEQ ID NO: 12821 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuuccuggggacaguggutt

SEQ ID NO: 12822 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accacuguccccaggaaautt

SEQ ID NO: 12823 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuggggacaguggugugtt

SEQ ID NO: 12824 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaccacuguccccaggatt

SEQ ID NO: 12825 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggggacagugguguggtt

SEQ ID NO: 12826 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaccacuguccccaggtt

SEQ ID NO: 12827 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugguggaaauaauaaagtt

SEQ ID NO: 12828 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuauuauuuccaccaactt

SEQ ID NO: 12829 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugguggaaauaauaaaggtt

SEQ ID NO: 12830 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuuuauuauuuccaccaatt

SEQ ID NO: 12831 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguggaaauaauaaaggutt

SEQ ID NO: 12832 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accuuuauuauuuccaccatt

SEQ ID NO: 12833 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccaacaagggagcaaatt

SEQ ID NO: 12834 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuugcucccuuguuggugutt

SEQ ID NO: 12835 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaacaagggagcaaautt

SEQ ID NO: 12836 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugcucccuuguuggugtt

SEQ ID NO: 12837 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacagaauucaaauucccutt

SEQ ID NO: 12838 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agggaauuugaauucuguatt

SEQ ID NO: 12839 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcacauccuuggacaatt

SEQ ID NO: 12840 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuguccaaggaugugccuutt

SEQ ID NO: 12841 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauccuuggacaaagguctt

SEQ ID NO: 12842 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccuuuguccaaggaugutt

SEQ ID NO: 12843 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaaaggucuuccggcccctt

SEQ ID NO: 12844 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggggccggaagaccuuugutt

SEQ ID NO: 12845 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcaauugcacugugcagtt

SEQ ID NO: 12846 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugcacagugcaauugccutt

SEQ ID NO: 12847 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcagccgucugcuggagutt

SEQ ID NO: 12848 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuccagcagacggcugcatt

SEQ ID NO: 12849 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgucugcuggaguacacactt

SEQ ID NO: 12850 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guguguacuccagcagacgtt

SEQ ID NO: 12851 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gucugcuggaguacacacctt

SEQ ID NO: 12852 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguguguacuccagcagactt

SEQ ID NO: 12853 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacaccacuggaagcuugtt

SEQ ID NO: 12854 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagcuuccagugguguuatt

SEQ ID NO: 12855 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagaaccaccuccuuugcgtt

SEQ ID NO: 12856 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgcaaaggaggugguucuctt

SEQ ID NO: 12857 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggugagaagaaagaugaggtt

SEQ ID NO: 12858 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccucaucuuucuucucacctt

SEQ ID NO: 12859 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuuuggaaucugccautt

SEQ ID NO: 12860 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggcagauuccaaaggaatt

SEQ ID NO: 12861 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaucuuuggagccacugatt

SEQ ID NO: 12862 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucaguggcuccaaagaucatt

SEQ ID NO: 12863 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaauaaagguccuaggaactt

SEQ ID NO: 12864 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guuccuaggaccuuuauuatt

SEQ ID NO: 12865 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuauacagaauucaaautt

SEQ ID NO: 12866 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auuugaauucuguauaauutt

SEQ ID NO: 12867 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cggagagcugcaagccagutt

SEQ ID NO: 12868 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuggcuugcagcucuccgtt

SEQ ID NO: 12869 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caagccagugcagcagccutt

SEQ ID NO: 12870 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggcugcugcacuggcuugtt

SEQ ID NO: 12871 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagccagugcagcagccuutt

SEQ ID NO: 12872 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaggcugcugcacuggcuutt

SEQ ID NO: 12873 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccuucagcuuuugguatt

SEQ ID NO: 12874 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccaaaagcugaaggcugtt

SEQ ID NO: 12875 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuucagcuuuugguagcatt

SEQ ID NO: 12876 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcuaccaaaagcugaaggtt

SEQ ID NO: 12877 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuuugguagcaugaaagutt

SEQ ID NO: 12878 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuucaugcuaccaaaagtt

SEQ ID NO: 12879 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uagcagagauaaagauggctt

SEQ ID NO: 12880 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaucuuuaucucugcuatt

SEQ ID NO: 12881 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauaaagauggcagcaagtt

SEQ ID NO: 12882 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuugcugccaucuuuaucutt

SEQ ID NO: 12883 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuggccaggguccugacatt

SEQ ID NO: 12884 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugucaggacccuggccaggtt

SEQ ID NO: 12885 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaggccacaggaagucagtt

SEQ ID NO: 12886 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacuuccuguggccugutt

SEQ ID NO: 12887 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caggccacaggaagucagutt

SEQ ID NO: 12888 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acugacuuccuguggccugtt

SEQ ID NO: 12889 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuuugugauucuggagaatt

SEQ ID NO: 12890 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucuccagaaucacaaagutt

SEQ ID NO: 12891 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuugugauucuggagaactt

SEQ ID NO: 12892 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucuccagaaucacaaagtt

SEQ ID NO: 12893 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugugauucuggagaacugtt

SEQ ID NO: 12894 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguucuccagaaucacaatt

SEQ ID NO: 12895 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugauucuggagaacuggtt

SEQ ID NO: 12896 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaguucuccagaaucacatt

SEQ ID NO: 12897 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugauucuggagaacuggutt

SEQ ID NO: 12898 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaguucuccagaaucactt

SEQ ID NO: 12899 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugauucuggagaacugguutt

SEQ ID NO: 12900 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccaguucuccagaaucatt

SEQ ID NO: 12901 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucugugacuuuggaagugtt

SEQ ID NO: 12902 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacuuccaaagucacagagtt

SEQ ID NO: 12903 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugugacuuuggaagugctt

SEQ ID NO: 12904 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcacuuccaaagucacagatt

SEQ ID NO: 12905 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccgaggagagcccaaugutt

SEQ ID NO: 12906 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acauugggcucuccucggatt

SEQ ID NO: 12907 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguugaucuuuggagccactt

SEQ ID NO: 12908 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guggcuccaaagaucaacutt

SEQ ID NO: 12909 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guugaucuuuggagccacutt

SEQ ID NO: 12910 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aguggcuccaaagaucaactt

SEQ ID NO: 12911 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaucuuuggagccacugtt

SEQ ID NO: 12912 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguggcuccaaagaucaatt

SEQ ID NO: 12913 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaucuuuggagccacugautt

SEQ ID NO: 12914 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucaguggcuccaaagauctt

SEQ ID NO: 12915 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auggucugcaggcugugugtt

SEQ ID NO: 12916 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacacagccugcagaccautt

SEQ ID NO: 12917 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcaggcuguguguuggcugtt

SEQ ID NO: 12918 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagccaacacacagccugctt

SEQ ID NO: 12919 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcugaauuguugcuaggatt

SEQ ID NO: 12920 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccuagcaacaauucagcctt

SEQ ID NO: 12921 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuuccuggggacaguggugtt

SEQ ID NO: 12922 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccacuguccccaggaaatt

SEQ ID NO: 12923 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuccuggggacaguggugutt

SEQ ID NO: 12924 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccacuguccccaggaatt

SEQ ID NO: 12925 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaacaagggagcaaauutt

SEQ ID NO: 12926 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauuugcucccuuguuggutt

SEQ ID NO: 12927 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caaauuauacagaauucaatt

SEQ ID NO: 12928 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uugaauucuguauaauuugtt

SEQ ID NO: 12929 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaccaccuccuuugcggagtt

SEQ ID NO: 12930 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuccgcaaaggaggugguutt

SEQ ID NO: 12931 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accaccuccuuugcggagatt

SEQ ID NO: 12932 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucuccgcaaaggagguggutt

SEQ ID NO: 12933 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaccuccuuugcggagagtt

SEQ ID NO: 12934 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucuccgcaaaggagguggtt

SEQ ID NO: 12935 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggaaauggaucauuuggugtt

SEQ ID NO: 12936 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caccaaaugauccauuucctt

SEQ ID NO: 12937 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaguggugagaagaaagautt

SEQ ID NO: 12938 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucuuucuucucaccacuctt

SEQ ID NO: 12939 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caucgagacauuaaaccactt

SEQ ID NO: 12940 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugguuuaaugucucgaugtt

SEQ ID NO: 12941 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgagacauuaaaccacagtt

SEQ ID NO: 12942 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugguuuaaugucucgatt

SEQ ID NO: 12943 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aucgagacauuaaaccacatt

SEQ ID NO: 12944 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugugguuuaaugucucgautt

SEQ ID NO: 12945 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccaucgagacauuaaacctt

SEQ ID NO: 12946 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gguuuaaugucucgauggctt

SEQ ID NO: 12947 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaucgagacauuaaaccatt

SEQ ID NO: 12948 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugguuuaaugucucgauggtt

SEQ ID NO: 12949 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaguaguggcaacuccutt

SEQ ID NO: 12950 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aggaguugccacuacugugtt

SEQ ID NO: 12951 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagacauuaaaccacagaatt

SEQ ID NO: 12952 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uucugugguuuaaugucuctt

SEQ ID NO: 12953 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
caguaguggcaacuccuggtt

SEQ ID NO: 12954 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaggaguugccacuacugtt

SEQ ID NO: 12955 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gagagcuccagaucaugagtt

SEQ ID NO: 12956 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucaugaucuggagcucuctt

SEQ ID NO: 12957 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgagacauuaaaccacagatt

SEQ ID NO: 12958 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugugguuuaaugucucgtt

SEQ ID NO: 12959 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agacauuaaaccacagaactt

SEQ ID NO: 12960 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
guucugugguuuaaugucutt

SEQ ID NO: 12961 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaaaacucugugacuuuggtt

SEQ ID NO: 12962 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccaaagucacagaguuuuatt

SEQ ID NO: 12963 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugugacuuuggaagugcatt

SEQ ID NO: 12964 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugcacuuccaaagucacagtt

SEQ ID NO: 12965 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gacuuuggaagugcaaagctt

SEQ ID NO: 12966 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcuuugcacuuccaaaguctt

SEQ ID NO: 12967 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aagugcaaagcagcugguctt

SEQ ID NO: 12968 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccagcugcuuugcacuutt

SEQ ID NO: 12969 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aauggaucauuugguguggtt

SEQ ID NO: 12970 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccacaccaaaugauccauutt

SEQ ID NO: 12971 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucugcuggaguacacaccutt

SEQ ID NO: 12972 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agguguguacuccagcagatt

SEQ ID NO: 12973 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaauggaucauuuggugugtt

SEQ ID NO: 12974 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacaccaaaugauccauuutt

SEQ ID NO: 12975 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gugagaagaaagaugaggutt

SEQ ID NO: 12976 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accucaucuuucuucucactt

SEQ ID NO: 12977 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auccauuccuuuggaaucutt

SEQ ID NO: 12978 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agauuccaaaggaauggautt

SEQ ID NO: 12979 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aaaacucugugacuuuggatt

SEQ ID NO: 12980 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccaaagucacagaguuuutt

SEQ ID NO: 12981 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggucugcaggcugugugutt

SEQ ID NO: 12982 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacacagccugcagaccatt

SEQ ID NO: 12983 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaaauggaucauuuggugutt

SEQ ID NO: 12984 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acaccaaaugauccauuuctt

SEQ ID NO: 12985 - RNA, 19 nt, Artificial Sequence
  source: /note="Description of Artificial Sequence: Synthetic oligonucleotide"
aacugcagauuaugcguaa

SEQ ID NO: 12986 - RNA, 19 nt, Artificial Sequence
  source: /note="Description of Artificial Sequence: Synthetic oligonucleotide"
ggcggcgggaaagcgucag

SEQ ID NO: 12987 - RNA, 19 nt, Artificial Sequence
  source: /note="Description of Artificial Sequence: Synthetic oligonucleotide"
ggcgcggaccagcucguuc

SEQ ID NO: 12988 - RNA, 19 nt, Artificial Sequence
  source: /note="Description of Artificial Sequence: Synthetic oligonucleotide"
ccuacuggaguacacgcca

SEQ ID NO: 12989 - RNA, 19 nt, Artificial Sequence
  source: /note="Description of Artificial Sequence: Synthetic oligonucleotide"
uacuggaguacacgccauc

SEQ ID NO: 12990 - RNA, 19 nt, Artificial Sequence
  source: /note="Description of Artificial Sequence: Synthetic oligonucleotide"
cacagauuacaccucgucc

SEQ ID NO: 12991 - RNA, 19 nt, Artificial Sequence
  source: /note="Description of Artificial Sequence: Synthetic oligonucleotide"
ccuaacuauacggaguuca

SEQ ID NO: 12992 - RNA, 19 nt, Artificial Sequence
  source: /note="Description of Artificial Sequence: Synthetic oligonucleotide"
gcgggcacuagcuucccgc

SEQ ID NO: 12993 - RNA, 19 nt, Artificial Sequence
  source: /note="Description of Artificial Sequence: Synthetic oligonucleotide"
ugaacccuaacuauacgga

SEQ ID NO: 12994 - RNA, 19 nt, Artificial Sequence
  source: /note="Description of Artificial Sequence: Synthetic oligonucleotide"
acccuaacuauacggaguu

SEQ ID NO: 12995 - RNA, 19 nt, Artificial Sequence
  source: /note="Description of Artificial Sequence: Synthetic oligonucleotide"
cccuaacuauacggaguuc

SEQ ID NO: 12996 - RNA, 19 nt, Artificial Sequence
  source: /note="Description of Artificial Sequence: Synthetic oligonucleotide"
uuacgcauaaucugcaguu

SEQ ID NO: 12997 - RNA, 19 nt, Artificial Sequence
  source: /note="Description of Artificial Sequence: Synthetic oligonucleotide"
cugacgcuuucccgccgcc

SEQ ID NO: 12998 - RNA, 19 nt, Artificial Sequence
  source: /note="Description of Artificial Sequence: Synthetic oligonucleotide"
gaacgagcugguccgcgcc

SEQ ID NO: 12999 - RNA, 19 nt, Artificial Sequence
  source: /note="Description of Artificial Sequence: Synthetic oligonucleotide"
uggcguguacuccaguagg

SEQ ID NO: 13000 - RNA, 19 nt, Artificial Sequence
  source: /note="Description of Artificial Sequence: Synthetic oligonucleotide"
gauggcguguacuccagua

SEQ ID NO: 13001 - RNA, 19 nt, Artificial Sequence
  source: /note="Description of Artificial Sequence: Synthetic oligonucleotide"
ggacgagguguaaucugug

SEQ ID NO: 13002 - RNA, 19 nt, Artificial Sequence
  source: /note="Description of Artificial Sequence: Synthetic oligonucleotide"
ugaacuccguauaguuagg

SEQ ID NO: 13003 - RNA, 19 nt, Artificial Sequence
  source: /note="Description of Artificial Sequence: Synthetic oligonucleotide"
gcgggaagcuagugcccgc

SEQ ID NO: 13004 - RNA, 19 nt, Artificial Sequence
  source: /note="Description of Artificial Sequence: Synthetic oligonucleotide"
uccguauaguuaggguuca

SEQ ID NO: 13005 - RNA, 19 nt, Artificial Sequence
  source: /note="Description of Artificial Sequence: Synthetic oligonucleotide"
aacuccguauaguuagggu

SEQ ID NO: 13006 - RNA, 19 nt, Artificial Sequence
  source: /note="Description of Artificial Sequence: Synthetic oligonucleotide"
gaacuccguauaguuaggg

SEQ ID NO: 13007 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacugcagauuaugcguaatt

SEQ ID NO: 13008 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcggcgggaaagcgucagtt

SEQ ID NO: 13009 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggcgcggaccagcucguuctt

SEQ ID NO: 13010 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuacuggaguacacgccatt

SEQ ID NO: 13011 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacuggaguacacgccauctt

SEQ ID NO: 13012 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cacagauuacaccucgucctt

SEQ ID NO: 13013 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccuaacuauacggaguucatt

SEQ ID NO: 13014 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggcacuagcuucccgctt

SEQ ID NO: 13015 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacccuaacuauacggatt

SEQ ID NO: 13016 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acccuaacuauacggaguutt

SEQ ID NO: 13017 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cccuaacuauacggaguuctt

SEQ ID NO: 13018 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuacgcauaaucugcaguutt

SEQ ID NO: 13019 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cugacgcuuucccgccgcctt

SEQ ID NO: 13020 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacgagcugguccgcgcctt

SEQ ID NO: 13021 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uggcguguacuccaguaggtt

SEQ ID NO: 13022 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gauggcguguacuccaguatt

SEQ ID NO: 13023 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacgagguguaaucugugtt

SEQ ID NO: 13024 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ugaacuccguauaguuaggtt

SEQ ID NO: 13025 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gcgggaagcuagugcccgctt

SEQ ID NO: 13026 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uccguauaguuaggguucatt

SEQ ID NO: 13027 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacuccguauaguuagggutt

SEQ ID NO: 13028 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaacuccguauaguuagggtt

SEQ ID NO: 13029 - RNA, 19 nt, Artificial Sequence
  source: /note="Description of Artificial Sequence: Synthetic oligonucleotide"
acuguaacauaguccgacu

SEQ ID NO: 13030 - RNA, 19 nt, Artificial Sequence
  source: /note="Description of Artificial Sequence: Synthetic oligonucleotide"
cuguaacauaguccgacug

SEQ ID NO: 13031 - RNA, 19 nt, Artificial Sequence
  source: /note="Description of Artificial Sequence: Synthetic oligonucleotide"
gccagacacuauagucgag

SEQ ID NO: 13032 - RNA, 19 nt, Artificial Sequence
  source: /note="Description of Artificial Sequence: Synthetic oligonucleotide"
aacauaguccgacugcggu

SEQ ID NO: 13033 - RNA, 19 nt, Artificial Sequence
  source: /note="Description of Artificial Sequence: Synthetic oligonucleotide"
gaccacuguaacauagucc

SEQ ID NO: 13034 - RNA, 19 nt, Artificial Sequence
  source: /note="Description of Artificial Sequence: Synthetic oligonucleotide"
uaacauaguccgacugcgg

SEQ ID NO: 13035 - RNA, 19 nt, Artificial Sequence
  source: /note="Description of Artificial Sequence: Synthetic oligonucleotide"
cauaguccgacugcgguau

SEQ ID NO: 13036 - RNA, 19 nt, Artificial Sequence
  source: /note="Description of Artificial Sequence: Synthetic oligonucleotide"
acacuauagucgagccaag

SEQ ID NO: 13037 - RNA, 19 nt, Artificial Sequence
  source: /note="Description of Artificial Sequence: Synthetic oligonucleotide"
cauauaucuguucucggua

SEQ ID NO: 13038 - RNA, 19 nt, Artificial Sequence
  source: /note="Description of Artificial Sequence: Synthetic oligonucleotide"
uacaggacaagcgauuuaa

SEQ ID NO: 13039 - RNA, 19 nt, Artificial Sequence
  source: /note="Description of Artificial Sequence: Synthetic oligonucleotide"
acuguaacauaguccgacu

SEQ ID NO: 13040 - RNA, 19 nt, Artificial Sequence
  source: /note="Description of Artificial Sequence: Synthetic oligonucleotide"
agucggacuauguuacagu

SEQ ID NO: 13041 - RNA, 19 nt, Artificial Sequence
  source: /note="Description of Artificial Sequence: Synthetic oligonucleotide"
cagucggacuauguuacag

SEQ ID NO: 13042 - RNA, 19 nt, Artificial Sequence
  source: /note="Description of Artificial Sequence: Synthetic oligonucleotide"
cucgacuauagugucuggc

SEQ ID NO: 13043 - RNA, 19 nt, Artificial Sequence
  source: /note="Description of Artificial Sequence: Synthetic oligonucleotide"
accgcagucggacuauguu

SEQ ID NO: 13044 - RNA, 19 nt, Artificial Sequence
  source: /note="Description of Artificial Sequence: Synthetic oligonucleotide"
ggacuauguuacagugguc

SEQ ID NO: 13045 - RNA, 19 nt, Artificial Sequence
  source: /note="Description of Artificial Sequence: Synthetic oligonucleotide"
ccgcagucggacuauguua

SEQ ID NO: 13046 - RNA, 19 nt, Artificial Sequence
  source: /note="Description of Artificial Sequence: Synthetic oligonucleotide"
auaccgcagucggacuaug

SEQ ID NO: 13047 - RNA, 19 nt, Artificial Sequence
  source: /note="Description of Artificial Sequence: Synthetic oligonucleotide"
cuuggcucgacuauagugu

SEQ ID NO: 13048 - RNA, 19 nt, Artificial Sequence
  source: /note="Description of Artificial Sequence: Synthetic oligonucleotide"
uaccgagaacagauauaug

SEQ ID NO: 13049 - RNA, 19 nt, Artificial Sequence
  source: /note="Description of Artificial Sequence: Synthetic oligonucleotide"
uuaaaucgcuuguccugua

SEQ ID NO: 13050 - RNA, 19 nt, Artificial Sequence
  source: /note="Description of Artificial Sequence: Synthetic oligonucleotide"
ucgaguagaagaaauaccg

SEQ ID NO: 13051 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acuguaacauaguccgacutt

SEQ ID NO: 13052 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuguaacauaguccgacugtt

SEQ ID NO: 13053 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gccagacacuauagucgagtt

SEQ ID NO: 13054 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
aacauaguccgacugcggutt

SEQ ID NO: 13055 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
gaccacuguaacauagucctt

SEQ ID NO: 13056 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaacauaguccgacugcggtt

SEQ ID NO: 13057 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauaguccgacugcgguautt

SEQ ID NO: 13058 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
acacuauagucgagccaagtt

SEQ ID NO: 13059 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cauauaucuguucucgguatt

SEQ ID NO: 13060 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uacaggacaagcgauuuaatt

SEQ ID NO: 13061 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cgguauuucuucuacucgatt

SEQ ID NO: 13062 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
agucggacuauguuacagutt

SEQ ID NO: 13063 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cagucggacuauguuacagtt

SEQ ID NO: 13064 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cucgacuauagugucuggctt

SEQ ID NO: 13065 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
accgcagucggacuauguutt

SEQ ID NO: 13066 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ggacuauguuacagugguctt

SEQ ID NO: 13067 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ccgcagucggacuauguuatt

SEQ ID NO: 13068 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
auaccgcagucggacuaugtt

SEQ ID NO: 13069 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
cuuggcucgacuauagugutt

SEQ ID NO: 13070 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uaccgagaacagauauaugtt

SEQ ID NO: 13071 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
uuaaaucgcuuguccuguatt

SEQ ID NO: 13072 - DNA, 21 bp, Artificial Sequence
  source: /note="Description of Combined DNA/RNA Molecule: Synthetic oligonucleotide"
  source: /note="Description of Artificial Sequence: Synthetic oligonucleotide"
ucgaguagaagaaauaccgtt

SEQ ID NO: 13073 - RNA, 19 nt, Artificial Sequence
  source: /note="Description of Artificial Sequence: Synthetic oligonucleotide"
agcuccagaucaugagaaa

SEQ ID NO: 13074 - RNA, 19 nt, Artificial Sequence
  source: /note="Description of Artificial Sequence: Synthetic oligonucleotide"
ucugcuggaguauacacca

SEQ ID NO: 13075 - RNA, 19 nt, Artificial Sequence
  source: /note="Description of Artificial Sequence: Synthetic oligonucleotide"
ugcuggaguauacaccaac

SEQ ID NO: 13076 - RNA, 19 nt, Artificial Sequence
  source: /note="Description of Artificial Sequence: Synthetic oligonucleotide"
cacugauuauaccucuagu

SEQ ID NO: 13077 - RNA, 19 nt, Artificial Sequence
  source: /note="Description of Artificial Sequence: Synthetic oligonucleotide"
ccaaacuacacagaauuua

SEQ ID NO: 13078 - RNA, 19 nt, Artificial Sequence
  source: /note="Description of Artificial Sequence: Synthetic oligonucleotide"
ugaacccaaacuacacaga

SEQ ID NO: 13079 - RNA, 19 nt, Artificial Sequence
  source: /note="Description of Artificial Sequence: Synthetic oligonucleotide"
acccaaacuacacagaauu

SEQ ID NO: 13080 - RNA, 19 nt, Artificial Sequence
  source: /note="Description of Artificial Sequence: Synthetic oligonucleotide"
cccaaacuacacagaauuu

SEQ ID NO: 13081 - RNA, 19 nt, Artificial Sequence
  source: /note="Description of Artificial Sequence: Synthetic oligonucleotide"
uuucucaugaucuggagcu

SEQ ID NO: 13082 - RNA, 19 nt, Artificial Sequence
  source: /note="Description of Artificial Sequence: Synthetic oligonucleotide"
ugguguauacuccagcaga

SEQ ID NO: 13083 - RNA, 19 nt, Artificial Sequence
  source: /note="Description of Artificial Sequence: Synthetic oligonucleotide"
guugguguauacuccagca

SEQ ID NO: 13084 - RNA, 19 nt, Artificial Sequence
  source: /note="Description of Artificial Sequence: Synthetic oligonucleotide"
acuagagguauaaucagug

SEQ ID NO: 13085 - RNA, 19 nt, Artificial Sequence
  source: /note="Description of Artificial Sequence: Synthetic oligonucleotide"
uaaauucuguguaguuugg

SEQ ID NO: 13086 - RNA, 19 nt, Artificial Sequence
  source: /note="Description of Artificial Sequence: Synthetic oligonucleotide"
ucuguguaguuuggguuca

SEQ ID NO: 13087 - RNA, 19 nt, Artificial Sequence
  source: /note="Description of Artificial Sequence: Synthetic oligonucleotide"
aauucuguguaguuugggu

SEQ ID NO: 13088 - RNA, 19 nt, Artificial Sequence
  source: /note="Description of Artificial Sequence: Synthetic oligonucleotide"
aaauucuguguaguuuggg

SEQ ID NO: 13089 - RNA, 19 nt, Artificial Sequence
  source: /note="Description of Artificial Sequence: Synthetic oligonucleotide"
cugcaauauugugaggcug

SEQ ID NO: 13090 - RNA, 19 nt, Artificial Sequence
  source: /note="Description of Artificial Sequence: Synthetic oligonucleotide"
gcccgccacuucaccaagg

SEQ ID NO: 13091 - RNA, 19 nt, Artificial Sequence
  source: /note="Description of Artificial Sequence: Synthetic oligonucleotide"
aauauugugaggcugagau

SEQ ID NO: 13092 - RNA, 19 nt, Artificial Sequence
  source: /note="Description of Artificial Sequence: Synthetic oligonucleotide"
gaccacugcaauauuguga

SEQ ID NO: 13093 - RNA, 19 nt, Artificial Sequence
  source: /note="Description of Artificial Sequence: Synthetic oligonucleotide"
caauauugugaggcugaga

SEQ ID NO: 13094 - RNA, 19 nt, Artificial Sequence
  source: /note="Description of Artificial Sequence: Synthetic oligonucleotide"
uauugugaggcugagauac

SEQ ID NO: 13095 - RNA, 19 nt, Artificial Sequence
  source: /note="Description of Artificial Sequence: Synthetic oligonucleotide"
ccacuucaccaaggccaag

SEQ ID NO: 13096 - RNA, 19 nt, Artificial Sequence
  source: /note="Description of Artificial Sequence: Synthetic oligonucleotide"
ccuacaucuguucucgcua

SEQ ID NO: 13097 - RNA, 19 nt, Artificial Sequence
  source: /note="Description of Artificial Sequence: Synthetic oligonucleotide"
uccaggacaagagguucaa

SEQ ID NO: 13098 - RNA, 19 nt, Artificial Sequence
  source: /note="Description of Artificial Sequence: Synthetic oligonucleotide"
agauacuuuuucuacucca

SEQ ID NO: 13099 - RNA, 19 nt, Artificial Sequence
  source: /note="Description of Artificial Sequence: Synthetic oligonucleotide"
agccucacaauauugcagu

SEQ ID NO: 13100 - RNA, 19 nt, Artificial Sequence
  source: /note="Description of Artificial Sequence: Synthetic oligonucleotide"
cagccucacaauauugcag

SEQ ID NO: 13101 - RNA, 19 nt, Artificial Sequence
  source: /note="Description of Artificial Sequence: Synthetic oligonucleotide"
ccuuggugaaguggcgggc

SEQ ID NO: 13102 - RNA, 19 nt, Artificial Sequence
  source: /note="Description of Artificial Sequence: Synthetic oligonucleotide"
aucucagccucacaauauu

SEQ ID NO: 13103 - RNA, 19 nt, Artificial Sequence
  source: /note="Description of Artificial Sequence: Synthetic oligonucleotide"
ucacaauauugcagugguc

SEQ ID NO: 13104 - RNA, 19 nt, Artificial Sequence
  source: /note="Description of Artificial Sequence: Synthetic oligonucleotide"
ucucagccucacaauauug

SEQ ID NO: 13105 - RNA, 19 nt, Artificial Sequence
  source: /note="Description of Artificial Sequence: Synthetic oligonucleotide"
guaucucagccucacaaua

SEQ ID NO: 13106 - RNA, 19 nt, Artificial Sequence
  source: /note="Description of Artificial Sequence: Synthetic oligonucleotide"
cuuggccuuggugaagugg

SEQ ID NO: 13107 - RNA, 19 nt, Artificial Sequence
  source: /note="Description of Artificial Sequence: Synthetic oligonucleotide"
uagcgagaacagauguagg

SEQ ID NO: 13108 - RNA, 19 nt, Artificial Sequence
  source: /note="Description of Artificial Sequence: Synthetic oligonucleotide"
uugaaccucuuguccugga

SEQ ID NO: 13109 - RNA, 19 nt, Artificial Sequence
  source: /note="Description of Artificial Sequence: Synthetic oligonucleotide"
uggaguagaaaaaguaucu

SEQ ID NO: 13110 - RNA, 19 nt, Artificial Sequence
  source: /note="Description of Artificial Sequence: Synthetic oligonucleotide"
acugcaauauugugaggcu

We claim:

1. A double-stranded ribonucleic acid (dsRNA), comprising a sense strand and an antisense strand, each strand between 15 and 30 nucleotides in length and the dsRNA comprising a duplex structure between 15 and 30 basepairs in length and the sense strand comprising a first sequence and the antisense strand comprising a second sequence, the second sequence comprising a region complementary to at least 16 contiguous nucleotides of SEQ ID NO:13096.

2. The dsRNA of claim 1, wherein the sense strand comprises SEQ ID NO:13096 and the antisense strand comprises SEQ ID NO:13107.

3. The dsRNA of claim 1, wherein the sense strand consists of SEQ ID NO:13096 and the antisense strand consists of SEQ ID NO:13107 and each strand includes an overhang of 0, 1, or 2 nucleotides.

4. The dsRNA of claim 1, wherein said dsRNA comprises at least one modified nucleotide.

5. The dsRNA of claim 4, wherein said modified nucleotide is chosen from the group of: a 2'-O-methyl modified nucleotide, a nucleotide comprising a 5'-phosphorothioate group, a terminal nucleotide linked to a cholesteryl derivative or dodecanoic acid bisdecylamide group, a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

6. The dsRNA of claim 4, comprising at least one 2'-O-methyl modified nucleotide and at least one nucleotide comprising a 5'-phosphorothioate group.

7. The dsRNA of claim 1, wherein the region of complementarity is between 19 and 21 nucleotides in length.

8. The dsRNA of claim 1, wherein the region of complementarity is 19 nucleotides in length.

9. The dsRNA of claim 1, wherein administration of the dsRNA inhibits expression of GSK3 by more than 40%.

10. The dsRNA of claim 1, wherein the dsRNA exhibits an IC50 of less than or equal to 10 nM in suppressing GSK3.

11. The dsRNA of claim 1, wherein the dsRNA exhibits an IC50 of less than or equal to 1.0 nM in suppressing GSK3.

12. A cell comprising the dsRNA of claim 1.

13. A vector comprising at least one strand of the dsRNA of claim 1.

14. A cell comprising the vector of claim 13.

15. A pharmaceutical composition for inhibiting expression of an GSK-3 gene comprising the dsRNA of claim 1.

16. A method of inhibiting GSK-3 expression in a cell, the method comprising:
 (a) introducing into the cell the dsRNA of claim 1; and
 (b) maintaining the cell produced in step (a) for a time sufficient to obtain degradation of the mRNA transcript of a GSK-3 gene, thereby inhibiting expression of a GSK-3 gene in the cell.

17. The dsRNA of claim 1, the second sequence comprising a region complementary to at least 17 contiguous nucleotides of SEQ ID NO:13096.

18. The dsRNA of claim 1, the second sequence comprising a region complementary to at least 18 contiguous nucleotides of SEQ ID NO:13096.

19. The dsRNA of claim 1, the second sequence comprising a region complementary to 19 contiguous nucleotides of SEQ ID NO:13096.

20. The dsRNA of claim 2 or 3, wherein said dsRNA comprises at least one modified nucleotide.

21. The dsRNA of claim 2 or 3, wherein said dsRNA comprises at least one 2'-O-methyl modified nucleotide and at least one nucleotide comprising a 5'-phosphorothioate group.

22. A pharmaceutical composition for inhibiting expression of an GSK-3 gene comprising the dsRNA of claim 2 or 3.

23. A method of inhibiting GSK-3 expression in a cell, the method comprising:
 (a) introducing into the cell the dsRNA of claim 2 or 3; and
 (b) maintaining the cell produced in step (a) for a time sufficient to obtain degradation of the mRNA transcript of a GSK-3 gene, thereby inhibiting expression of a GSK-3 gene in the cell.

* * * * *